United States Patent 7,309,815 (NUCLEIC ACID COMPOSITIONS CONFERRING DISEASE RESISTANCE) - sequence listing, part 2

SEQ ID NO: 986 - DNA, 708 bp, Artificial
  Synthetic
tgactaccccctcgacccacgcgctcgcgaatcgaaatggcttcagagaagaagttgagcaacccaatgagggaaatcaaggttcagaagttagtccttaacatctctgttggtgaaagcggagataggctcaccagagcagccaaggtcttggagcaactcagcggccaatcccctgttttctctaaggctaggtatactgtccggtccttcggaattaggcgtaatgagaagattgcttgctatgtcactgtcatgaggagacaaagctatgcagctccttgagagtgggttgaaagtcaaggaatacgagttgttgagaagaaacttcagtgagactggctgctttggttttggcattcaggagcacattgatcttggaatcaagtatgacccttcaaccggtatctatggtatggatttctatgttgtgcttgagcgcccaggataccgtgttgctcgtcgtaggaggtgcaaggcccgagttggaattcagcacagggtcacaaaggatgacgctatgaagtggttccaagtcaaatatgaaggtgttatccttaacaaatcctcaaacattcagtaagttgattgtggatcagtttgtcccccagcaagtttatgttttctatgcattttgtagaccaacatttaatactcctagagttcaaaggttttgaagagttgctgttatttggcatatcaggatat

SEQ ID NO: 987 - DNA, 665 bp, Artificial
  Synthetic
actccatccaacccttccagtccaaccttccaatccctcctcaaaccatcaaaatggcctcccgtgtcttcgcctcccgcctggcctcccagatggccaccaaggctgctcgccctgccatgcgtgctcctctcgccgctaccaagcgcaccatcaccactggcagccccatgcaggccatgaagcgccagaccatccaggctgctggacgcaacgccttccaggctcagcgccgcgcctactcttccgagatcgcccaggccatggttgaggtctccaagaacttgggtatgggttcttctgccatcggtctgaccggtgctggtgttggtatcggtgtcgttttcgctgcccttatcaacggtgttgcccgcaaccccgctctccgtggccagctcttctcctacgccattctgggtttcgctttcgttgaggctatcgctcttttcgacctcatgattgccctgatggccaagttcacctaaattgcctctcgagagattggaaaagctccggccagtggatggagcaattaatataaggggacgacgttggaccgtccgccacttggagtttgatggtttgtcaaatgcaattggggtgccgacgtgcacataaaacgaggaagacgatgcatcatagacggtgttagaggttgcggaagg

SEQ ID NO: 988 - DNA, 694 bp, Artificial
  Synthetic
ccgcaatccctccctcctcgaatgggtccaattgtcgcccgcaaatcgcccgcaccgtcgccgaagccgaatcattcatcatgtccgacgaggaaggccaggagcttgtcaccaagcccttcaagtttgtcactgctggtgagattgtccaacacggccccttctacgtgaacgaaacgaccgaccggctcgggcagcttcatcaatgcattgcccatcgactgcgagctacttacccgcagcttggaatagcttgagctttgcccgtcgccggaggacccgcttcgcagatatatataccttcgttatatatgcacacatgtcgctaacccgagtgctcgcgcaggcactgatgcccgtttccccaacgtgaatcagaccaagcactgctggcaaaactacgtcgactaccacaagtgcattctcgccaagggagaggactttgcgccttgccgtcagttctggttggcctaccgatcactgtgcccttctggatggtaccagcgatgggacgagcagcgcgagtctggtaacttccctgtgaagctcgatgcttaaattccatatttgaggtggcggggtacataagcaagggtgttcacatagattaagcagccaggcggcgcatgtgctgccagaaaatgtagtagtagtcaatcacaagcaaacaggctcaatttttgactgttaaaat

SEQ ID NO: 989 - DNA, 287 bp, Artificial
  Synthetic
aaccatcttcatccatcgtctttgattcatcaaacagctcttggatccgttctgatccagccaaccaaccatcgccatgtctgaacctctcaccaaggtcgactccgccgttcaaggcctgtcatcatcaccgcccaaagagaagggccataggagaacaagctctagcgcggctggtgttatgaccattgcggaaatcaatgaaagccatgctcctctagaactcgcaatagagacacagcagacagcgtggaaaataaatcagcggcccaaggatctcgacaatg

SEQ ID NO: 990 - DNA, 80 bp, Artificial
  Synthetic
catcaaacagctcttgggatccgttctgatccagccaacaaccatcgccatgtctgaacctctcaccaagtcgactccgc

SEQ ID NO: 991 - DNA, 594 bp, Artificial
  Synthetic
tcctattcacagcattctttcgcaatggggccctccgtcgtaatgatagacacctcggacgacttcttcgctgccccggtggcaacatcacagacgaagcgaactctcctcctggcgccgccgtctctcgcctctcacccaactgcgctcaccaacgtcgtgtctcaatatgatcgctctgctacagatcttcagatgatcgaccggttgtcagccggtctcgtcaagctgccgtctgctacatacgacctcgttctcgtcctcgccgatgcgtcttcctctctcaacgagaccctacccctcttgactagaagcatcccctgctggcgtcggcttcatcgacttctctgacgatctcgacgccgattacgacgatgacgagctcatcgacgaagacactcttatgaccgaagatgacctcaagcgacccatcaatatccctcccgaatgtcagcccaaagccggcaagcgccgccgcgcctgcaaggactgcacctgcggcctcgccgaacgtctcgaagctgaagacgccgccaagcgcgccgccgccgacaagggtctccagagcgtcaagctcgccgtcgacgacctcac

SEQ ID NO: 992 - DNA, 702 bp, Artificial
  Synthetic
ttctctctgcataccaaaccacttcctccccccgcaagcaaacacagtcttttcagctctctctgggcttttatatacgcatagactcttccatcgttctttgtcaaattcatcctcctcttcaaccacaacaagccttcgttacaccgctttacgaagccccttcttctctcctctcctccattcttctaccttttccacacaacaaacacacacacagtcacaatggccttctctactcgaagcgtactgcgcgcctctcgcgccgtcaacttctcagctgcctcccgtgttgctgctcccagcaacgccgtccgcttcttctcggcctcccgtgccgtccgcgtgtctgacactgccaacaagaagagcgttgttcgcgagaaggaggttcccgtcaccgtctatggcgctggccagggtgacaagcagacactgcaggttcctgatggcgcctccaaggtcccctacgacagccccgtccccgctgagcgtgaggaggtcgagcctcttaacaagaaggtctacgaccagctgcctcacaccgtcaagagcatgacggttcaggacaaggtcatcatcatcactggtggtgctcgaggcctgggcaaccacatggcccgagcctgtgccgaggctggtgccaaggccatcatcatcttcgatgccaaccaggagctgggcgacgcttccgctgctgag

SEQ ID NO: 993 - DNA, 688 bp, Artificial
  Synthetic
cccacgcgtccgctccctcaacaaatatcacacttccattacatctttgaagttcttttcattcattttatcaaaatgacaaattcctccaattctgtttttgcccatgttgttcgtgctcctgaagatcccatcttaggagtcacagttgcttataacaaagataccagcccactgaagttgaatttgggtgttggcgcatatcgcactgaggaaggaaagccccttgttcttaatgtggtgagacgggctgaacaaatgctcgtcaatgacacgtctcgggtgaaggagtatctctcaattactggactagcggattttaacaagctgagtgcaaagcttatatttggtgctgacagccctgccattcaagagaacagggtgactactgttcagtgcttgtcgggcacaggttctttgagggttggggctgagtttctggctaagcattatcatgaacgtactatatatataccacagccaacatggggaaaccatccgaaggttttcactttagccgggcttttagtaaaatattaccgttactacgacccagcaacacgaggcctggatttccaaggacttttggatgatcttgctgctgcacccgctggagcaatagttcttctccatgcatgtgctcataacccaactggcgttgatccaacaaatgaccagtgggagaaaa

SEQ ID NO: 994 - DNA, 667 bp, Artificial
  Synthetic
aaaaaaggaaagttagcaagcaaaggtttcgtactgtcaaaatgaacatgtcacaacaatcaccgtcaccgtccgctgaccggaggttgagtgttctggcgagacaccttgaaccatcgtcctgcgccaccgtcgaatcctctatcgtcgctgctcctacctccggaaatgctggaaccaactctgtcttctctcacatcgttcgcgctcccgaagatcctattcttggcgtcactattgcttacaataaagatagcagccccatgaagttgaatttgggagttggtgcatatcgcacagaggaaggaaaacctcttgttttgaatgttgtaagacaagcagagaagctactagtaaatgacaggtcccgcgttaaagagtacctatctattactggactggcagacttcaataaattgagtgctaagctgatacttggcgccgacagccctgctattcaagagaacagagtaacaactgtccagtgtttgtctggcacaggctcattgagggttggagctgaatttttggctcgacattatcatcaacgcactatttatattccccaaccaacatggggaaaccacccaaaagttttcactttagctgggttatcagtaaagagttaccgctactatgatccagcaactcgtggactcaattttca

SEQ ID NO: 995 - DNA, 708 bp, Artificial
  Synthetic
catggcgatccgagccgcgatttccggtcgttccctcaagcttagctcgtcggtaggagcgcgatctttgtcgtcgttgtggcgaaacgtcgagccggctcctaaagatcctatcctcggcgttaccgaagctttcctcgccgatcctactcctcataaagtcaatgttggcgttggagcttacagggacgacaatggaaaacccgtggtactggagtgtgtcagagaagcagagcggaggatcgctggtagtttcaacatggaatatcttcctatgggaggtagtgtcaacatgatcgaggagtcactgaagttagcctatggggagaactcagacttgataaaagataagcgcattgcagcaattcaagctttatctgggactggagcgtgccgaatttttgcagacttccaaaggcgcttttgtcccgattcacagatttatattcctgttcctacatggtctaatcatcataacatttggaaagatgctcacgtccctcagaaaacgtaccattattatcatcctgaaacaaaggggttagactttgctgcactaatggatgatataaagaatgccccaaatggatccttctttctgcttcatgcttgtgctcacaatcctactggggtggatcctacagaggaacaatggagggagatctcacaccagttcaaggtgaagggacattttgctttctttgacat

SEQ ID NO: 996 - DNA, 655 bp, Artificial
  Synthetic
  misc_feature (176)..(176): The residue at this position can be any nucleotide.
ccctcgaccacgcgtccgcggacgcgtgggtttcatcgatcagttcttccctttctcttcggttccctgtaaaaccaaagcctccccatttttctcttctacccgagctttaagatggcttccacaatgttctctctagcttctgccgctccgtcagcttctttttccttgctgantatctcaagtcaaagctgaagttggggacttctaaccaaagtgcctttttcgggaacgacttcgtgaaggcaaagtcaaatggtcgtactactatgactgttgctgctaacgtctctcgatttgagggaataactatggctcctcctgaccccattcttggagtttctgaagcattcaaggctgatacaaatgaactgaagcttaaccttggtgttggagcttaccgcacggaggagcttcaaccatatgtcctcaatgttgttaagaaagcagaaaaccttatgctagaaagaggagataacaaagagtatcttccaatagaaggtttggctgcattcaacaaagtcacagcagagttattgtttggagcagataacccagtaattcagcaacaaagggtggctactattcaaggcctgtcaggaactgggtcattgcgtattgctgcagcactgatagagcgttacttccctggctc

SEQ ID NO: 997 - DNA, 561 bp, Artificial
  Synthetic
atctagtcatctcacgacatttgactaacgactctatttattaacctgacggtgcaccccaacccagtaacacgttactaactaccccgtctctatcaccacgtgactctgaaccaaatctttggctttattttcacgttcccaacacaaaatccaaaccgccaatcaccccatctttttaatcagcaactctcccctcaacactacggttttcgaagtagttatttattcatatttataatgtcatactttgcatcagtccccgcagctcccgcagatgcccttttcggcctcatggccaagtacaaggccgataccttcgacaagaaggtcgacctcggagtcggagcctaccgagataacaccggaaaaccctgggtcctccctgtcgtctccaaggtcgattctctgattgtcgccgaccccactgccaaccacgagtacctccccatcactggtctgccagacttcaccaagtctgccgccaagctgattctggggcctgactctcctgccatcaaggagaaccgagttgcctcttgccagacaatctctggaact

SEQ ID NO: 998 - DNA, 682 bp, Artificial
  Synthetic
gatcagctatggagagcgtggcgctcaagcgagtttctgctgtagccaaccatctcaatcccgagcagcagcagcagcagcagcagcagcaactctccatggctgtcgccgccagcgccggcgcctcttcggtgtttgatcatctggagcaggcgcccgaggatcccattctgggaataactgtggcatacaacaaggaccctcatcccgggaaagtgaaccttggagtcggagcttaccgcacagaggaagggaaaccccttattttgcatgtggttcatcgtgctgaggaacgtcttctagctgatcgctccagaaacaaggaatacttgtcaatcactgggctggcagactttaacaagcgaagcgcgacgctcattcttgggagcgatagccctgctatcgtggagaagagattggtaactgcgcagtgcctttctggaacgggttccttgcgtgtaggagccgagtttctttcaagacattatggtgtgaagctggttttccttcctaccccgacgtggggaaatcacttcaaggttttcatgaatgctggacttggtgttaagacgtatcgttactatgacagcaaaactcgtggtcttgactatgagggtatgctcgaggacataagtgcagctccgaccggatcggttattctcttgcatgcatgtgctcataa

SEQ ID NO: 999 - DNA, 579 bp, Artificial
  Synthetic
acagggagagtagcttccattccattccatccggtagggctatggcgactagcatggcgctcaacgagattgctgctccagcggcgtccaagatgtcttccagcccagccgcaaagagcttcgttgggctccgcacggctgcgttttccacgaagaaggcatcttttccatccatgaagtgtgctgcgaaggtcaatatggctatcgctgccgacgtttctcgctttgagaacgttagcatggcacctccggatccaattctcggtgtttcagaggcattcaaggcagataacgatgctaccaagttaaaccttggcgttggtgcttacaggaccgaggatctccaaccttatgttcttaaagtcgtgagaaaggctgagaagctcatgctggagaagggagagaacaaagagtatcttcctatcgagggtcttgccgcatttaacaaggccactgccgaacttctactcggagctggcaatccagttatcaagaatggccggattgccaccgttcaaggcctatctggaaccgggtctctgcgtctgggagctgcatttattgcaagatacttcccct

SEQ ID NO: 1000 - DNA, 728 bp, Artificial
  Synthetic
gctagcgggcttgtcaggaacgcggggaagcgattcatgtctactgcggcggcggcttcggcatcgtcggctccagctggagctcgatccggatggtgggaagccgtgcagccggcgccgcgggatccgatcctcggcgtcactgaggcttttctcgccgattccgatcccaaaaaggtcaatgttggcgtgggcgcgtataggaacgatgagggcaagccggtcgtgctggaatgcgtccgcaaggccgagcaaatcattgctggcaagcaaaatatggaatatcttccaatgggaggccttgtgaagtttaatgatctctccgtcaagcttgcctatggcgactccgctccagttcttgaggagaagcgagtggccgcggtccagacgctctctggaactggtgcttgcagacttttcgctgatttccagaagcgattcaagccagactcacgcatttacatcccggttcctacctgggccaaccatcataacatttggagggatgcccgagtcgaggctcacactttccgctactacaagccaagtacgcggggattggacttcgaagggtttgtggaagatctgaaaaaagcgccggagggatctttcgtcctgctgcatgcttgcgctcacaaccccaccggagttggacccaccgccgagcagtggaaggaaatttctcagcttttcaagagcaatggactcttcccgttcttcgacatggc

SEQ ID NO: 1001 - DNA, 786 bp, Artificial
  Synthetic
tcatcatcgtcctctcaatctcgttcccaatcaactccgtctgcctctctcgcccgcatcaacaacattgcgagccacatctctcccacaatggcttccaccaccagtttcccggcagaaacggtgccccaggcgcctgaagatcccctctttggcctggcccgcgcctacaaggctgacaacagcccgctaaaggtcgacctgggaatcggcgcctaccgagataacaatgcgaagccatgggttcttcctgtggtaaagaaggctgatgagattctccgaaacaaccccgaactgaaccacgagtatgccccgattgcaggtatcgagagcttcaccagcaaggctgcggagctgatgctcggcgccgattcgcccgctctcgcggagcgccgcactacgtctatgcagaccatctcgggaaccggtgccgttcacttgggagctctgttcctcgccaagttttacaaaggcagccagaccgtctatgtgtcaaatcccacatgggcaaaccaccatcagatcttttccaatgtcggcatcaaggtcgcccagtatccctacttcagcaaggagacccgggggctggactttgatggcatgaccgctgccatctcagcggctcctgaaggttccatcatcctgctccacccctgtgcgcacaacccaaccggcgtcgacccaacacttgatcagtggaaggagttggccgtcattatccgagagaagaagcacttccccttctttgactgtgcctaccagggctttgcctctggcgaccttgct

SEQ ID NO: 1002 - DNA, 73 bp, Artificial
  Synthetic
aatctcgttcccaatcaactccgtctgcctctctcgcccgcatcaacaaacattgcgagccacatctctccac

SEQ ID NO: 1003 - DNA, 609 bp, Artificial
  Synthetic
gaattcacaaccatggaatctcaaaactctgggttctaatatttcaatgtctcctactgcttctcatggtgattctgtttttgctcacattgttcaagctcctgaagatccaattttaggggttactgttgcttataataaagatccaagtccaattaagttgaatttaggagttggagcttatcgaactgaggaaggaaaaccacttgtattgaatgttgtaagaaaagctgaacagatattagttaatgacaggtctcgtgtgaaagagtatcttcctattactggattgggagaatttaacaaattgagtgccaagctcatttttggtgctgacagccctgctatccgtgagaacaggattactactgtccaatgcttgtctggcactggctcgctgagggtgggaggtgagtttcttgcaagacattaccatcagcgaacaatatatattccacagccaacatgggggaaccatatcaaagtattccaattggcagggttgtctgtgaaatattatcgctactatgacccaaaaacacgtggattggacttccaaggtatgctgggggatctctcttctgctccatcaggagccatagttcttct

SEQ ID NO: 1004 - DNA, 740 bp, Artificial
  Synthetic
agtagctaaccaggtaagagatgaagcacaacaatgttatacctaatgggcacttcaagaagcattggcaaaactatgtaaggacttggttcaaccagccagctaggaaaacaaggagacgtgctgctagacagcagaaggctgtgaagatcttccctaggccgactgcgggatcacttcgacctattgttcatggacaaacactgaaatacaacatgaaagtccgggctgggaggggattttctcttgaagaactgaaagcagctggtattcccaagaaactagcaccaaccattggcattgctgttgatcatcgccgcaggaacagatcattggaaggtctccaaaccaatgtccagaggctcaagacttacaaagctaagcttgtcatcttcccaaggcgtgctaagaaagtcaaggctggtgattctagtgtagaggaacttgctactgccacccaggtccaaggttcttacatgcctattactagggagcagccagctgttgaacttgtcaaggtcacagatgagatgaaatcattcaatgcctatggcaagctgcgtatcgagcgtacaaatgcgcgacacatcggagccaggttgaagagggcagctgaagcagaataggaagaatagaaataagcacttacaattgtcgtgtagcttgttaagcatgatcagttttctggtggactgagtgatgaagcttttgatacaatcatattcaggatcttgagcttt

SEQ ID NO: 1005 - DNA, 637 bp, Artificial
  Synthetic
ggaaggggataggttgtttctcagctaggtcagaagccagaggtgaggcagaatgaagcacaacaacgtgatcccgaatgggcatttcaagaagcattggcagaactatgtcaagacgtggttcaaccagcctgccaggaagaagcgcagacgcgtcgcgaggcaaaagaaggctgtgaagatcttcccccgacctaccgggggacccctccggcccgttgtccactcacagactctgaggtacaacatgaaggttcgtgctggccgaggcttcactctggaggagctcaaggcagcaggcatttctagaaaactggctccaacaattggtgttgcagtagaccatcgaaggaagaatcgttgcctagaaagccttcaagtcaatgtgcagaggctcaacacatacaaggccaagcttgttgttttccctcgacgtgcacgaaagaccaaggctggtgactcttctcctgaggagcttgccaatgctacacagatccaaggatctgcccttcctattataaaggacaaggcggttgttgagcttgtgcctcttacagatgagctcaaggcccagaagggctacgccaagcttcgtgttgagaggatgaatacgcgaatgataggcatcagaaacaag

SEQ ID NO: 1006 - DNA, 552 bp, Artificial
  Synthetic
ggcgaggtagggatcgtatggaagcgctgcgggcattcgcagccgcagcgatccccttgctggcagggtttcgttggcggcgggcagcggcgatggtgaaggggaacaatgtcatccccaatcagcatttcaagaaggattgggagcgacgggtgaagacgtggttcaatcagccggcgcgcaaggtccggagaaggaaggctcggtcgatcaaggctgccaaaatcttcccacggccgacgtccggacccctgcgcccgattgtccactgcccgaccgtcaagtacaacagcaaggtcaagtacggccggggtttcacgctggaagagctcaaagaagctgggatcccgaagaagcttgcccggacgattgggatctcgatggatcaccggaggaagaaccgcagcctggagagcttgcagatcaatgtccagcggctgaatacctacaagacgaagctcgtcgtctttccctcgcaatgctaagaaacccaaggctggcgactcgtcgccgcaggagctgagcagcgtggtgcagctctcgggcccggtg

SEQ ID NO: 1007 - DNA, 742 bp, Artificial
  Synthetic
tgacgagtctcctcctccgaaatttcaacgacttccgaacaacgaccaccggagcccacgttgatcgcaagcagacacaatggcgatcaagcacaaccagacgatcatcagcaaccatttccgcaaggattggcagcgccgggttcgcacccactttgaccagcccggtcgcaagacacggagacgcactgctcgtcaggccaaggctgctgctctcgctcctcgtcccgtcgacaagctgcgacccatcgtccgatgccctaccgttaagtacaaccgacgggttcgtgccggtcgaggtttcaccctcaccgagctcaaggaggccggtatctccaagtccctggctcccaccatcggtatctccgtcgatttccgccgacagaacctgagcgaggagagccttgccgccaacgttgcccgcctcaaggcctacaaggagcgcctcatcctcctgccccgcaagtccaacgcccccaagaagggtgacaccaagaccgacgtcgcctccctcgacaaggtcgcctccatcgccgctgccctgcccatcgcctccgtctctgctggcttctccgagatcaagaagagcgagatccccgccgctgtcgagggtggtgcctacaccaagcttcgcattgctcgaagcaacgccagataccagggtgcccgtgagaagcgtgctcgggacaaggctgaggccgagactgccaagaaataaactttgtcaaaaagggaactggtg

SEQ ID NO: 1008 - DNA, 534 bp, Artificial
  Synthetic
gacaaaaatggctatcggtaagaactaccccctcgtcaagaaccatttccgaaagaactggcaggagcgggtcaagacccactttgaccagcccggcaagaagtcttctcgacgacttgcacgaaccaagaaggccgctgctatcgctccccgacctctggatcttctccgacctattgtccgagcccccactatccgatacaaccgaaaggtccgagctggccgaggtttctctcttgaggagctcaaggctgccggtatcccccgagactacgctcgaaccattggtattgccgttgaccaccgacgacagaaccgatccgttgagggtcttgaggccaacgttctgcgactcaaggagtaccagtccaagctgattgtcttcccccgaaagctcaagaagggtgagaccaacgaggccaagtccgccgtccaggtcctctccacctctgctaccttccccattgtccaccaggctgccgagtccgagccccgagccatctctgccgagggcaaggagcagaacgcatacag

SEQ ID NO: 1009 - DNA, 573 bp, Artificial
  Synthetic
ccccccctcgctctgccaccgctcgtcttcctcccaccttccgccgccgccgccgtcggtctcctcttcgctccgccgcgcaggtaagaaggagaggaggagaaaatggtgaagcacaacaacgttatccccaatggccacttcaagaagcactggcagaactatgtcaagacatggttcaaccagcccgcccgcaagcagaggcgccgcattgctcgccagaagaaggctgtgaagatcttcccccgcccaacatctggccctcttcgacccattgttcagtgccaaactttgaagtacaacatgaagtcgagggctgggagaggctttacccttgaggagctgaaggctgcgggcatccccaagaagtatgctccaaccattggaatttccgtggatcaccgccgcaagaaccgctcacttgagggactccaggctaatgtccagaggctcaagacatacaaggccaagctggttatcttcccaaggcgtgctcgcaaggtcaaggctggtgattccactgccgaggaacttgccactgccacccaggtccagggtgactacatgcctatt

SEQ ID NO: 1010 - DNA, 823 bp, Artificial
  Synthetic
gctccactcgttctgctcggtgtcctcgtcgtcgttgtcgtgtttaagtcatgaagcataacaatgttattccgaatggacacttcaagaaaaactggcagaactatgtgaagacctggttcaatcagccagcacgcaagaccaggagaagaattgcaaggcaaaagaaggctgtgaagattttccccagaccaaatgctggaactcttcgccctattgtccatggtcagacactcaaatacaacatgaaagttaggtctggtagaggattctcccttgaggagctcaaggctgcaggtatccctaagaaactggctccaacaattggtattgctgttgatcatcgtcgcaggaatcggtcacttgaggggcttcaaactaatgttcaaaggctgaagacatacaaggccaaattagtcgtcttcccaagacgtgctcgcaaggtcaaggctggtgattctgcccccgaggaattggctacggcaacacaagtccatggtgcttacatgcctattgcacgtgagaagccatcagttgatcttgtcaaggttactgaagagatgaagtcattcaatgcctatggcaagctacgtgtggagcggacgaatgagcgtcacattggtgctaggatgaagagagctgcagaggctgagaaggaggaaaagaagtagtgaggcttatcttggttgatttacttgtcccatctttttgagtcctatttcgttaattaattacagaatttgctttgaactttttagctatagcattcaatgtcagctgggtgtatgattttcaacacttgttactttgttgatgagatttt

SEQ ID NO: 1011 - DNA, 605 bp, Artificial
  Synthetic
agccttgccttggcaaatagacaacagagaccctgtttcaagcccgttgactctgtgaagccagatctggatttggcttccatgcgtgcgtcttatactttcaggagaacgccgcagtagactacttaaagacttactctccccacgtcaagacgttcctcttcatccatcttttccaagcacgacaccatgactacccgctcccttcctagcaatggcagctctgcctttgactacatcatcgttggtggaggcaccgcaggctgtgtgattgcctcgagactctccagctatctgcccgagctccgcgttcttctcatcgaggctggtccctccgactttaacctcaaccacgtcctcaatctgagagaatggctgagcctgctgggcggcgagctagactacgactacggcacgacagagcagcccatgggtaacagccatatccgccattctcgtgccaaggttcttggaggatgctcgtcacacaacacgctcatttccttccgtcctttccgccacgacatggaccgctgggttgctcagggctgcaaaggctggacctttgagaatgtcactcgtcacattgacaaccttcgcaacac

SEQ ID NO: 1012 - DNA, 560 bp, Artificial
  Synthetic
ccgccactttgctctcctttcaagcatcgcaaaactctgtcaactctttttataatactctgactcttcgtccactctctgcttctgaaccacttcgactcatactacttgcacttgcatacactcgggactcttcccccgcctactctactcttctacacaaccaaccaccaacgcaatggctctcgacatgtcaccctctctcctccaaccggggcctcaccccctcgagctcacacagcagcctctgctccatgcagagcgtatcctctaccgccgaggcgagccagctgtcagacaaggcacgcatggaactgcgagcatacgctgtttcattcgagcagggtagactgcagcgcccgcgatcatactaaataaccaaaatcatcatcctacaaacaaaacatacacacacataccacactctaccatctaccatctaccattacgcaactcaatcatacgcaacacaatatgaaacgatacgaaaccatcctaccattacttgctatactgttcttgttcttttaaaacaagcccattttcttttacctcatttt

SEQ ID NO: 1013 - DNA, 728 bp, Artificial
  Synthetic
ttctaccactttgctctcctttcaaggcatcgcgaagactcttgtcaactctttttataatactctgactcttcgtccactctctgcttctgaaccacttcgactcatactacttgcacttgcatacactcgggactcttcccccgcctactctactcttctacacaaccaaccaccaacgcaatggctctcgacatgtggactcacgagttctgccttacttgcgaccgacaggtccaggtcgacggcgacgcctactgctctgaagcatgcagaatgtccgacttcgaaaagactccctctactcccagctcgcaggccagctcgcccggcttctctcccgtctcctacgctagatcaggcagcctctccagccgacctgctcccaccaagttcttcctgtctcccgcctacgacttcaaccaggcccagccctacggctcaactcctcggtcgtcatcgtcgtttggcagctacatgtcggacatgtcacctctctcctccaaccggggcctcaccccctcgagctcacacagcagcctctgctccatgcagagcgtatcctctaccgccgaggcgagccagctgtcagacaaggcacgcatggaactgcgagcatacgctgtttcattcgagcaggtcagactgcagcgccggcgatcatactaaataaacaacatcatcatcctacaaacaacacatacacacacataccacactctaccatc

SEQ ID NO: 1014 - DNA, 668 bp, Artificial
  Synthetic
tcagctcacactctccaggctcacacaaaactcactacaataaaaacacaatcttcaattctttgaacctttttcaagtttcgccaacatgaagttcaccactactgccgttcttgccattgccgcattcgttgaatcggccactgctctgggcaaggcccgtgtcgtcaacaagtgccccttcagcgtcaccacctggtccgttggcagcgccatctccaacccaacaacccttgctcaaggcggttcctatggcgagaccttctcacgagaccccgtaaccggcggtcgtgccatcaaggtcaccgtccagcccgatggcctctacactggcaagccccagaccaacttcgccatcaaccttgagggcaacaccatctggtacgatctttcagatgtctttggcgatgccttcaacggccacaaggtcgttgtttccagcgccaacactgcttgcccccagattgtttggggcagcggaatccctcctgccggaagccaggtcaagaactgcggtgcggataaggatgtgactttgactctgtgtgcttagagttaagggaggacggaatcatgtcaagggaaaggtttaaatcaagtttatgatagaatttcaagtcctagctatgtttaagacttatgacagtatgaattgatgagtttactgc

SEQ ID NO: 1015 - DNA, 674 bp, Artificial
  Synthetic
ctctactggacagcacttccacaagatttgtttactttcatatctttttgcataggttcagcaacaagcatcaagctgtgttatcgtagctgctgcttctctcccaaagtgacctgattgtcaccttttccacttgcaattgccaccgcaaagctccaataccgcaaacatgtctgctgtcaacggcgctcacagcagcacttccaaggccaccgatcaagatggctcttcggttcccggcttccagccccagaacaagatgacggtccagccgcccaggggagaagacctccaggtcagctatgccgctgaaattggaggcgaggccaaccccaagggctggtatggcagcatgatcaacaatcttggcgcatgcattggaacatgcggcgccattccctgctgtgtcatctgccccaacccttataagcacgtcaaccaaggccatgttggtctcgtcaccaagttcggtcgtttctacaaggctgtcgaccccggtctgatcaaggtcaaccccctcagcgagaggctcattcaagtcgatgtcaagatccagatcgcagaggtgcctgagcagacctgtatgaccaaggacaatgtcactctgcgcctgacctctgtcatctactatcacattgtgtctcctcacaaggccggttttggtatttctaacg

SEQ ID NO: 1016 - DNA, 628 bp, Artificial
  Synthetic
cgatcagtcgacaattcattcaagatggctaaggaaacgcctgcaaagaccggtctggccgttggcctgaacaagggccacaagaccactgctcgtgtcgtcaagccccgtgtttctcgcaccaagggccacctgagcaagcgaaccgctttcgtgcgtgaggtcgtcaaggaggttgctggcctcgccccctacgagcgtcgtgtcatcgaactgctccgaaacagcaaggacaagcgtgcccgtaagctggccaagaagaggctcggtacctttggccgtgccaagagaaaggtcgatgagctccagcgcgtcatcgccgagtctcgtcgtgctcactaaacgatttcttctttaagcgagcgggagagattcatcttggtaatggggaaaaacaaaaattatttcaacagggaaatgaattaaaaaaacactacgggtttcgcatggatttggcgtggtcatgaattttgattgaattcaaatggggctctttgatgcgggcgcagcagcgtttatatagctgcgatttcgttcatcgaatttcttaaactcttcaagacatgccgtctttatgacccaacctagaaaattttcttcttctaggaaaaaaaaaaggaaaaaggaa

SEQ ID NO: 1017 - DNA, 214 bp, Artificial
  Synthetic
gatcagtcgacaattcattcaacatggctaatgaaacgcctgtaaatatcggtctggccgttggcctgaacaagggccactagatctctgctcttgtcatcaagccccgtgtatctcgcaactagggccaactgatcaagcgaaccgctttcgtgcgtgacgtcctcaaggacgttgatggcctctccccctacaaccgtcgtgtcatcaaact

SEQ ID NO: 1018 - DNA, 642 bp, Artificial
  Synthetic
agagagagagagagagagagagagagatggcgctcgcaatcctggcgaggaggcggggggcggaggcgctgctgcgacggccgctgggggcggcgggggtgtcggcgctgagggcgtcgtacgcggcggtggcgggggaggagagcgacgtggtggtggtgggcggcgggccgggagggtacgtggcggcgatcaaggcggcgcagctggggctcaagaccacctgcatcgagaagaggggcaccctcggcgggacatgcctcaacgtcggctgcatcccctccaaggctctgttgcactcatctcatatgtaccatgaagcaaaaagttcctttgcacaccatggagtgaaattttccaatctggaggtagacctcccagctatgatggcacagaaagacaaggctgtggcaggcctgactaaggggattgaaggtctcttcaagaagaacaaagtgacgtatgtcaaaggctttgggaaacttgcttcgccctcagaggtgtctgttgatctgagcgatggtggcagcacagttgtcaaagggaaaaacataatcattgctacagggtctgatgtaaaatcactccctggagtcacaattgatgaaaagaaaatcgtctcatctactggggccttgtgct

SEQ ID NO: 1019 - DNA, 670 bp, Artificial
  Synthetic
gagaaaatggcgatagggagcttagcaagacgaaaggccacaacaattttatcttccagatatctctatagcacatccaaatattcattttctcttaacagatattactcttcgggatctgatgaaaacgacgtcgttgttatcggcggtggacccggcggctatgtggcggcgattaaagctgcacagcttgggctcaaaactacttgtattgagaaacgtggtacccttggtggtacctgtctcaatgttggttgtattccttctaaggcacttcttcactcctcccacatgtaccatgaagctcaacattcatttgctagtcatggtgtgaagttctcttccgttgaggtagatcttcctgccatgatgggccaaaaagataaagctgtggctaacttaacacgaggtattgagggtctattcaagaagaacaaagtgaactatgttaagggctatggcaaattcctttctccttctgaagtttctgtcgacactgtggaaggtggtaatactgttgttaaggggaagaatattataattgccactggttctgatgtcaaaagtctacctgggctaactattgatgagaagagaattgtatcatccactggagctttagctttgaccgaagttccaaaaaagctggttgttattggtgctggctaca

SEQ ID NO: 1020 - DNA, 539 bp, Artificial
  Synthetic
gattcgcttgggtcctcgcattgctcggcgggttgccatggccatggcgggaggcagggggaggagcgccgctctcggattgggtcggctcctgtacacgaggaatggcttcatcggtcgcttgggtgtgaggggctttgcgtccggcggcgaagagaatgacgtaattgtcatcggcggcggacctggcggatacgttgcggcgatcaaggcggcgcagctgggattcaagacgacctgcatcgacaagagaggttccctcggcggcacttgcctcaacgtcggatgcatcccttccaaagcactgctccactcgtcgcatatgttccacgaagccaagcacacattctccaagcacggcgtgaagctgtccggtgtggacatcgacgtcgcacccatgatggcgcagaaggagcaggccgcgtcggggctgactaagggaatcgagggcctgttcaagaagaacaaggtgacgtacgtcaaaggcagcggcaagatcgtgtcccccaacgacgtgtctgtggagacgctcgactcgg

SEQ ID NO: 1021 - DNA, 601 bp, Artificial
  Synthetic
atagcacctgtcaacggctgcccagcatgattgctagccgcctgataccccgaagtgccatccgcacgctgcccagcaggcaattgaccctgtcacgatggagtcgaggatttgcctctgcttctgaggagaaggacctgatcatcatcggtggtggtgttgccggatatgtggccgccatcaaggccggacaggagggcatgaaggtggcctgcattgagaagcgtggcaccctcggcggtacctgcttgaacgttggctgcattccctcaaaatcgctgctcaacaactcccacctgtaccaccagattctccatgactcaaaaaaccgcggtatcgaggtcggagaggttaaactcaacctcgagactttcatgaaggccaaggaaaccgccgttaccggcctgaccaagggtgtcgagttcctcctgaagaagaacggcgccgagtacatcaagggcaccggttccttcatcaacgagaacgaaatcaaggtcgaactcaatgacggcggcgagtccgtcatccgcggcaagaacattctcatcgccaccggctctgaagccactcccttccccggcctcaccattgacgagcagcg

SEQ ID NO: 1022 - DNA, 703 bp, Artificial
  Synthetic
  misc_feature (67)..(67): The residue at this position can be any nucleotide.
  misc_feature (629)..(629): The residue at this position can be any nucleotide.
gaattcaggaagaagaagccatggcaatggcaagtttagcaagaaagaaggctttatatttcagtancaatctcggcaaatcttcatcatcgtcatttaaatattcgttttcagtttcaagaggttttgcttctggatcggctactgatgagaacgatgttgttatcattggaggtggtcctggtggttatgtagcagcgattaaggctgctcaattaggtcttaagaccacttgtattgaaaaacgtggtgctcttggtggtacttgtcttaatgttggttgtatcccttctaaggcccttttacactcctcccacatgtaccatgaagccaagcatgcatttgctaatcacggtgttaaggtttcaaatgtggaagttgatttgcctgcaatgcttggtcagaaagataaagcggtttccaatctcactcgaggtattgaaggcctcttcaagaaaaacaaggtaacatatgtcaagggttatggtaagcttatctctccatctgaggtctctgtcgaaaccattgaaggggaaaacactgttgtcaaaggtaaaaacattataattgcaacagggtcagatgtgaaacctcttccaggtataactattgatgaaaagaagattgtntcatcaaccggagctctatctttatcagaaatccccaagaaacttgttgtcattggagcaggttatattggtct

SEQ ID NO: 1023 - DNA, 244 bp, Artificial
  Synthetic
cccacgcgtccgcccacgcgtccgcccacgcgtccgcccacgcgtccgacatcctctacaacaagcaaacagcttggatcaacagcctcattaattggcttcaatataccctcatacattaatatatataccccgacagcaccgccacctcgagctccttgaagcatcgtcatccccacaacacccattaataccctttagaagcaacttgcacttaataccgccaaaatgttcggcaacttgg

SEQ ID NO: 1024 - DNA, 554 bp, Artificial
  Synthetic
ggacgttggtgtcatcagtgtcctactgcgcgagttggtgcgacacggctgccagcacattcggccgtctctggggacgatataccccgagactgcgccgcggcaagtctttggctggatctctcgccgcttttctcgtcggcgtggccacctcgtacctctggtacgggtggctggtcccaactataggacccatgcccggtgacgagaacttcatgttcacgggcactctgtcgctgccgcgagcattgaccgaggccgtcggcatcccggacagcatggcatccgtctccggctccgtggcccttggcatcatgagcgtctggtctggatttgtcgcctctgccagcgaagtggccgacctcttcggatgggatgacaacttgacgatcccggtgcttagcggaatcggcatttggggcttccttaaagtgtttggctaaccatacacaaccttctctataggaggctgcatttgtttcgataatggtatataactgtgttttcacatcttcttcactctgtaatgcagtttcttctctcttcctccccct

SEQ ID NO: 1025 - DNA, 359 bp, Artificial
  Synthetic
gtctcgccgcttctccaaccccattgacgttgctgagcgtgaataccgagaacgtttccgtcctcaacaacccgaagctactaccggtcttgaactagttcaagtccgtcgtcctcatcaccagaagtcaaagtcctctcacaaggtctctgacatcaccgtcgacgagcgtgtttctattgcccgtcccaacttccgtgaggatatcaagatcactgaggaaatccgcgagtctactccgtatccttccgaacaatcagccaagatgggttactacgacgacgaagagcacgttgaggttgatgttgtccgccacgatgctaattcttcgcgccgcccagctcctgccaccgagtcgc

SEQ ID NO: 1026 - DNA, 635 bp, Artificial
  Synthetic
tgattcatctcgccgcttctccaaccccattgacgtgctgagcgtgaataccgagaacgtttccgtcctcaacaacccgaagctactaccgttcttgaactagttcaagtccgtcgtcctcatcaccagaagtcaaagtcctctcacaaggtctcttttatcaccgtcgacgagcgtgtttctattgcccgtcccaacttccgtgaggatatcaagatcactgaggaaatccgcgagtctactccgtatccttccgaacaatcagccaagatgggttactacgacgacgaaggctcctaccactccatccgccaggatgtcaagcatggcttggccaaggctgccgacaagctgcttccccatcatcaccaccaccaccatcatcacagtgacaataataacactaccattacagagcacgttgaggttgatgttgtccgccacgatgctaattcttcgcgccgcccagctcctgccaccgagtcgcagcctaacactgtgtccatcccctgccaccacatccgtctgggtgacttcttgatgctccagggccgaccatgccaggtcatccgcatctcgacctcgtctgccactggccagtaccgctaccttggtgttgacctcttcaccaagca

SEQ ID NO: 1027 - DNA, 1147 bp, Artificial
  Synthetic
ggaacaaagaaagaaaagactctcagaggggtggaatccctctctcttttctctctctcttcgacttttgtttcaggaacaaaagcttgaggatccttcttgtcttcctttcgtgatcttacggaaggttgtatgagaagattctctcgcgccagcgcaagccgtcaacctggactttgaagcccgagttcccgtgccctttagcatcttcccgtccacttataaggacaacgaagcagcacgccctcagactcaaatcaccactcacgaggaggttcaactaaccctccctcaaaagaagccagccggacgggagggtcaactctcttctttccccccaagcaccgacctagctcctcctcgcgtcgaacaacgctttgaagaagaggtccgtatcactcgtgaggaagaacgtcaccgccgtcccggttcccgccagtccgaacgcttcgtaaaggaagagttccgacctatcccacctcctcctcgcgactacactgagactcaggtcaaagttgattcatctcgccgcttctccaaccccattgacgttgctgagcgtgaataccgagaacgtttccgtcctcaacaacccgaagctactaccggtcttgaactagttcaagtccgtcgtcctcatcaccagaagtcaaagtcctctcacaaggtctctgacatcaccgtcgacgagcgtgtttctattgcccgtcccaacttccgtgaggatatcaagatcactgaggaaatccgcgagtctactccgtatccttccgaacaatcagccaagatgggttactacgacgacgaagctcctgccaccgagtcgcagcctaacactgtgtccatcccctgccaccacatccgtctgggtgacttcttgatgctccagggccgaccatgccaggtcatccgcatctcgacctcgtctgccactggccagtaccgctaccttggtgttgacctcttcaccaagcagctgcacgaggagtcttccttcattgccaacccccgcccccagcgttgttgtccagaccatgctcggccctgtcttcaagcagtaccgtgtcctcgacatggctgacggcttcgtcactgccatgaccgagaccggtgatgtcaagcagggtctggctgtcattgaccagtc

SEQ ID NO: 1028 - DNA, 339 bp, Artificial
  Synthetic
cccacgcgtccgcccacgcgtccgacattcgttgtctgaacactaaaccaaaaaactccaaaaaaacaacttaatacacacccccccaacaacacttaataccgacaagatgaaggccgctttcgttgctgttgctctcgccgctctggcccaggctcagacccgcgctgatatcccatcctgcgctctgccctgcctcgacgacgccgtcaaggccaacaccaagtgctccaccaccgactacgcctgtatctgcaaggacttcaacgctgttcagggcgctgccaccggctgtgtcgttgagaagtgcggtaccgacgttgccatcaacaaggtcct

SEQ ID NO: 1029 - DNA, 540 bp, Artificial
  Synthetic
agctcgccaaggagattggctgcactcctgagcacctccagaagaccttccagacatacaatgctattgccgatggcaagcagaaggacccctggggcaagaagttcttccacaacctgcccgtcgacatcaacgacgacttccacgtcgctctcatggagcccgtcctccacttcaccatgggtggtgtcgagatcaacgacaaggcccaggtcctcaaccaggagaagcagcctttcgagggtctctacgcctgtggtgaactggctggtggtgtccacggtgccaaccgtctcggaggctcctcactgcttggctgcgtcgtctacggccgtgttgccggtgacagcgccagcagctacctcttccagcatgccctccagggcaccgccggcgctgctcagcgtctgggccagatctccctgcacctcgacccctctgctcccggcaagctgaccgtcgagtgggccaacggcgccgttgccggctccgctcccgctcaggtcgccgagaagcccgccgcttcttctgccggtgcca

SEQ ID NO: 1030 - DNA, 200 bp, Artificial
  Synthetic
cggacgcgtgggcctcgctgcaactccacgcctcgccaatctcgaacgcctgtcaaaatgctctcccgcgccgccactcgcaccacctccgtggtcgcccgccgaggcttccacaccacccgccctcgcatgtcctctccttaccactaccccgagggtccttactccaacttgcccttcaaccctcgcagcaagtggtt

SEQ ID NO: 1031 - DNA, 374 bp, Artificial
  Synthetic
cagatcattacaatcaaactcttaatctctattcttaaatacatctacctctcacaatggatttcgtcaacaaggctatgggcaaggaggagcgctccactcagggcaccgctcccgctgctccccaagcaggcggccaggtccagaaggacgattacgtcgacaaggctttcgccatgggtgccaaaaagagcggccacaacatggatcgcaacacacaggagaagattacggatgcaggccgtaacatgtacgagaaggtgacaggaaacaaggtcgaccccaagtggtctaattaatgaacggacgagttatgactcacaacaagactgtacaatagtaataataacatcttatcaacgctgtctgttcct

SEQ ID NO: 1032 - DNA, 643 bp, Artificial
  Synthetic
aaattcgaggtgttttagacgcaagcttctcttttacacactgaagctgctgctgcaaccatcaccaacataccacacgcaacaacacaacaccaccacgtaataacgagcagaacacccctcgcttgaacttgttgcaaaaaacactctcgcctctatttcataaatcaaattacacacgaacaaaacaatgaatccaacagtcagaggcttctcaaccgccgcaagagtgcacccgccctttttgccacatctccgcccatcgccgcgccgagccccgatccgacgctggctaaaaactgccgccgtcatcaccgccgtcggatacgcctcaaagacctacctcgacgccacccgcgcccagcgccgcgaaaccgccctcgcacttgaacatgattccgccgagaggcagcgcatgatggagaatttgtatggtgggagggagagcttggaggatttggagaagggggttgctgagtatggcaagcggtaatcaccgaaggaaaaacaaaaaaaaacgacaacagacggaaaaaaaaacttgaagtaaattcaaggggtattattacaccaaaagcggcgaggcatttggggggatttgcatcagggctgatggtgcccttgagcgaagcatacatgggag

SEQ ID NO: 1033 - DNA, 621 bp, Artificial
  Synthetic
cgccattagagttccatcgtattcactgctcagcagctgctacaactcgtccggccaaaatgacattcaagagaagaaacggaggtcgtaacaagcatggacgtggccacactaaattcattcgctgctctaactgcggcaagtgctgccctaaggacaaagcaatcaagaggttccttgtgaggaacatcgttgagcaagcagcagtgagggatgttcaggaagcttgtgcttttgaattgtacactcttcctaagctgtacttgaagatgcaatattgtgtctcatgtgccatccactccaaagttgttagggtccgctctgttactgataggagggtccgtgagcctccacagcgcttcagacgcccaagggatgatgctcccaagcctggtcaagctccacgccctgccggagctcctactgcagctcgttcttaagtgcctacattttgatcaactactgttaggcttttgagttttagttaatttgagatgtatttttgaagtggatttctctatttagttttactggaactatcattaaatttgtgtatgcaaatctcaagcaaacaggcctgttgttcgtcctatagcttatatatcctttgcaattaaactc

SEQ ID NO: 1034 - DNA, 1283 bp, Artificial
  Synthetic
gtccagccagaatttcatgccataaaatagtactaggtcccattaaactgaaccaaaaaagtactcaaaaccaccatatataacaaaactccatagtcactttcacactatagctaaacaacatgatcaaaacagcaggcactcaagtacgagctgctgctgtcggagcagctccaggaacccgtggagcttgaccaggctttggagcatcatcccttgggcgcctgaatcgctgtggaggctcacggaccctcctatcagttcgagagcggaccctaaccacctttgagtggatggcacatgatacacaatattgcatcttcagatacagcttaggcagagtgtacgtttcaaaagcacaagcttcctgcacatccctaacagctgcttgctcaacaatatttctcacaagaaacctcttgatggctttgtccttagggcagcatttgccgcagttggagcaacggacgaatttgacgtggccacgtccatgcttgttgcgacctccgttccttctcttgaaagtcattttcggagatggctggaactcgaccccacgcgtccgcccacgcgtccgcccacgcgtccgcccacgcgtccgcccacgcgtccgaacttacaaagccaagaaaccattgaagcacataacaaacgcgggttcgaaaaccggcaacaagtggtctatcgtccagccacaagaataccagaccgttgacgacgtgccgtatcagcgaggccgtcctctcccaacagtcacccccgtcttccagaacaagctgcccaactcgcctggcaagacgtccatcggcctcctcgtcgacttcccgcccaactcgtcgacgcccccccacacgcacggcggcgcggccatctccgtcttcgtcatcaagggcaccgtgctcaacaagatgaacgatggcccgactcgtgtgatcccggcgggcggcacgtggttcgaggcccccggctgccaccaccggaccagcgacaacttcagcaccacggagccggcgcagattctggcgacgatggtggttgacacaaagactgttgaagagggagggatggcggctcttgttgtgctcgacccggagtatgctgatatcagacttggttaaattgatatggatgctgcagtgaagagaaccggaagctcggaaagggtgtgggtgttgtcaatatcagaagtggccagcggaggctcggattgctgttagtaaacggggcatctcagcaggaaggcaaaatgaatatgtaaagcaatcaatggcaacgaatcgttt

SEQ ID NO: 1035 - DNA, 526 bp, Artificial
  Synthetic
ataaatggtaaaccacatttagtaaagatgaaaccagtaacagcagatccgatatttgaaaaagaacaggttggtcctagataaagttcaacaccctggtatcatgctagatttagggaaacgactgaaaaaaggtttatcactccggagacaatcaggtgcgagcaacgttgggggcaggagcagcagctccaccaggagcgggagcgccaccacctggacgagggccttggggcctatcctccctgcggcggaagcgttccggaggcctgcggtccctccggttctcacgggagcggacacggacgatgtgagcatggattgcacaggacacacagtgatgcaccttggcgtaaagcttggggagaacgtatccatcgtgcacgcacgcctcctggacgtccctgatggcggcctgctccacgatgttcctcacctgaaacctcttgatcgccttgtccttggggcagcacttggcgcagttggagcagcggatgtacttgacgtggccgcggccgtgcttgtt

SEQ ID NO: 1036 - DNA, 523 bp, Artificial
  Synthetic
aacagttcaatccagacaccgccaaaatggtcaagaagagaaagaacaacggccgcaacaagaagggccgcggccacaccaagcccatccgctgcagcaactgctcgcgatgcactcccaaggataaggcgatcaagcgcttcaccatccgcaacatggtcgagtctgctgccatccgtgatatctccgatgcctctgtcttcgccgagtacactgtccccaagatgtacctgaagctgcagtactgcgtctcttgcgctatccacggcaagattgtccgtgtccgatctcgcgttggccgccgtaacagggctcccccccctcgtgtccgctacaacaaggacggcaagaagatcacccctaccgctgcccccaaggtttaaaaaatgggtatgacgggaatgggttggacggagtctggtttactttaacgccttcatgtaatttgcttagatgaatacccaggacaaagagaatcctggagcctaaatgaatcggactttttttcttgttgaaaagattc

SEQ ID NO: 1037 - DNA, 588 bp, Artificial
  Synthetic
  misc_feature (517)..(517): The residue at this position can be any nucleotide.
gcagattatactcagaagctaccatccagagcgaaaatgactttcaagagaagaaacggaggtcgtaacaaacatggacgtggccacacaaaatttattcgttgctctaattgcggcaaatgctgcccaaaggacaaggccatcaagaggtttcttgtaaggaacattgttgagcaagctgctgtacgtgatgttcaggaagcttgtgcttttgaaacgtacactcttcctaagctgtacttgaagatgcaatattgtgtttcatgtgcaattcactctaaggtggtcagagttcgttctgttactgataggagagttcgtgagcccccacagcgtttcaggcgcccaagggatgatctcccaaagccaggtcaagctccacgccccgctggaggagcccctgctgcacctcgcacttaacttgataggcttcaggttttaattaatctgatagttattttatctgttatatgtcgtggttttgactgtactgtttgatttagttgatgggaccatntaccattttatggaattgaattttgaatggaaaatgagagatctaaattttcataatgaagcgcttttaag

SEQ ID NO: 1038 - DNA, 469 bp, Artificial
  Synthetic
ggaagaggtagaggactctttgtaggttttgcttgcagggtagaagactcttttactagggagctatgacggttaagcgtagaagtaggggacgaagtaagcatggccgtggtcatgttaatcccatccgatgctccaactgtggtcgatgctgccctaaggacaaagcagtgaagaggttccttgtccgcaacattgtcgagcaagcggcaatcagggatgtccaggaagcatgtgtttatgatggatatgttcttccaaagctttacacaaagatccaacattgcatctcttgcgctatccactcccgtgtagtacgtgtccgctccagagaggctcggaggaacagggagccaccacagcgtttccgtagaagggaggataatggcccaggacagaaccgtccccctccccctccccgcccttgagatttgtcaggcacttcattaatcctcgagacttagtgctt

SEQ ID NO: 1039 - DNA, 309 bp, Artificial
  Synthetic
cacgcgtcgcaaggacaaggccatcaagcgattcaccatccgaaacatggtcgaggccgcctccatccgagatctttccgaggcctccgtctaccaggagtacgtgctgcccaagctctacctcaagatccagtactgcgtgtcttgcgccatccactccaaggttgtccgagtccgatctcgagagggccgaaaggttcgaactcctccccagcgagtccgattcaacaaggacggtaagaagatcaaccctgctgccgccgccaaggttgtcgtttaggcgatgtataaaaaattgcactgtgtatg

SEQ ID NO: 1040 - DNA, 797 bp, Artificial
  Synthetic
tgggctttgcactgccaaaacggcccctccgccggcatggccataagaatggaggccttgtggaaagatcgtgaactttccatgtactttacttcgatcgtgaactgcacctcgcattacataaggtgatttatagcaggtaccacggtacaacaccaaaaagagcatacaccgccaaaatggtcaagaagagaaagaacaacggccgcaacaagaagggccgcggccacaccaagcccatccgctgcagcaactgctcgcgatgcactcccaaggataaggcgatcaagcgcttcaccatccgcaacatggtcgagtctgctgccatccgtgatatctccgatgcctctgtcttcgccgagtacactgtccccaagatgtacctgaagctgcagtactgcgtctcttgcgctatccacggcaagattgtccggtacgttgcctcccctgggagtgttacaactgcgcctttctggcgtatgtgcttcagatgagccttggttgtactttgggacgttcacacacgtcccagctctcgaacatatataccctcccccgtccccctaaaggtacgtttgacgctgacagaatcaaaatagtgtccgatctcgcgttggccgccgtaacagggctcccccccctcgtgtccgctacaacaaggacggcaagaagatcacccctaccgctgcccccaaggtttaaaaaatgggtatgacgggaatgggttggacggagtctggtttactttaacgccttcatgtaatttgcttagatgaatacccaggacaaagagaatc

SEQ ID NO: 1041 - DNA, 674 bp, Artificial
  Synthetic
caccatcaaacaacaatacaatccatagaggattacctctcaactcaaccacctttacgacaatcgcaactcaataagattctttcagtgtattatcactcaagatttgaatttcgattcgaccaagaaaactccaatcaaatttattacaccatataatattttcaacttcaaacatttttctcaatatgtctgctgctaccgtcacccgcgctgctgccagcactgttcgcaagcctatttccttctacactcaagtccgaagaatgggccgtgtctttgagagccacccatacgagagatttgcaaccaccatgaagcctgcaaagcccgactactacaagaacatttctttcactgctggcaaggttgtcacttatttccccatcatcggcgccatgcttggctggcccgtcctttgcaaatgggctttggacggacagatcggtcgcctgtaaagaggtgatagaggcaatggtatagagtgggacagcaaaaagatatagagatgtccatctttcgactgtatatatacactttgggcgtttggatggactatgggtgcgaagcatatttcggcgcaacacagattaattcaatttgattctctttgttaatttattcaaacgcgcgcctacacaacaatctgtgatataagaatgtgtcagccgaaa

SEQ ID NO: 1042 - DNA, 685 bp, Artificial
  Synthetic
tccgacaatccatagaggattacctctcaactcaaccacctttacgacaatcgcaactcaataagattctttcagtgtattatcactcaagatttgaatttcgattcgaccaagaaaactccaatcaaatttattacaccatataatattttcaacttcaaacatttttctcaatatgtctgctgctaccgtcacccgcgctgctgccagcactgttcgcaagcctatttccttctacactcaagtccgaagaatgggccgtgtctttgagagccacccatacgagagatttgcaaccaccatgaagcctgcaaagcccgactactacaagaacatttctttcactgctggcaaggttgtcacgtaagtaccccagacaatacaatacaacaaaccagtacatccatagagcggctgtactaacacttggatttttgcagttatttccccatcatcggcgccatgcttggctggcccgtcctttgcaaatgggctttggacggacagatcggtcgcctgtaaagaggtgatagaggcaatggtatagagtgggacagcaaaaagatatagagatgtccatctttcgactgtatatatacactttgggcgtttggatggactatgggtgcgaagcatatttcggcgcaacacagattaattcaatttgattctcttcgaaaaaaaa

SEQ ID NO: 1043 - DNA, 700 bp, Artificial
  Synthetic
atcaccaattgcaccccgccatggcttcaccaatggctgcctctcgccatgtccagcgcgtggctacacagatccgtctgcgctcagcgcgggttcccagaggccaattgaccttcaatcgatgggcatcgtccgcttcgggcagtcggcgagctcccgccagcttcggaacttcatcctcggcagccgtttggcttgcagccgccgccattggcatcacggctcccttggcctacagcttggtgagttttacacgataggcccggggagacacaattcatgccgagacctttccaacttacatgtctcttcttgtttccttttccagacaacagcagaacctgcaaagctcgacgtcacatcccttgccgaaaaggatgagcagaagaagagagaggcggttgtcaccgaagagtcgcccatgcgcctgcggatggaaaagttcatcaaggagcagcagcaaataattgtcaaggaactcgagcgcatcgacggcaagaagtttcgcaaagacgagtggacgcgacccaatggcggcggcggcataacctgtgtgctgcaggagggcaacgtattcgaaaaggccggtctcggcgtcagcgtcgtctacggaacgcttcccaagcccgccatcttgaagatgcgcgaaaatcacaagaacctcgaccccgacgtcgagtcgctggaatcttcgctgctg

SEQ ID NO: 1044 - DNA, 728 bp, Artificial
  Synthetic
atcccatcaccaattgcaccccgccatggcttcaccaatggctgcctctcgccatgtccagcgcgtggctacacagatccgtctgcgctcagcgcgggttcccagaggccaattgaccttcaatcgatgggcatcgtccgcttcgggcagtcggcgagctcccgccagcttcggaacttcatcctcggcagccgtttggcttgcagccgccgccattggcatcacggctcccttggcctacagcttgacaacagcagaacctgcaaagctcgacgtcacatcccttgccgaaaaggatgagcagaagaagagagaggcggttgtcaccgaagagtcgcccatgcgcctgcggatggaaaagttcatcaaggagcagcagcaaataattgtcaaggaactcgagcgcatcgacggcaagaagtttcgcaaagacgagtggacgcgacccaatggcggcggcggcataacctgtgtgctgcaggagggcaacgtattcgaaaaggccggtctcggcgtcagcgtcgtctacggaacgcttcccaagcccgccatcttgaagatgcgcgaaaatcacaagaacctcgaccccgacgtcgagtcgctggaattcttcgctgctggcctgagcatggtgctccatccgtacaaccccatggctcccaccgtgcacctgaattaccgatacttcgaaacgggcaatcccgacggtacctctcaggcgtggtggt

SEQ ID NO: 1045 - DNA, 650 bp, Artificial
  Synthetic
tctccatagagcttccggcccaggctcttatagaagtcagaattttttgcattccagtcttcatgagtcgcacctactctatgccaacgatgtcttgtacgtatttaccagcagtacagaggtaggacgtcaactcgccagcaaaaatagggatgaactcactctgaagctgcgtcatgtcaatatatattgatctctttgcatatcttcttgtcgaccgatatctaatgatagatcgttgatctggccaactttctgctatctttcaatccgccaccgttggaatcccaatgatattgaggccctcttctataaatgtacgtatgattcaagtaccagatctcgaatcctcgaatatatcgactttaatgtgttctgtttttcctctcagattctgagtcatatagatggtgtaccaagcaatcgacccatctaacaataactcgtatagaaaagaggtgctacttcttcatccaagcaatattttattgtttactagagtccttgcctcgctcattaaaataaacggtggagcgttgtagcgtaaataaatgaaagcggaggggttgccacgaggtcgacaactcaactcaagtcactccgatccggccataggtctctcaaaattcttctccgtttccttttatttg

SEQ ID NO: 1046 - DNA, 111 bp, Artificial
  Synthetic
gttgataccaaacaaaggtggaagtggatcttggggagagggagaaagatgattgcttgacatgtatgatacccaagataccccaggagaaatgatggcgataaagcaaaa

SEQ ID NO: 1047 - DNA, 617 bp, Artificial
  Synthetic
ggacggcagccatgaattccgcctcgcgacccggccagggccaattgttgggccttttgagatccggagtgcggtttgcacacacgggccggccacgaggggctgcggcaggatcccaagacgccgagagccatggagagaatatctgggtgtttgcccacagaagatcagaacaggtcatttacagcttcaccaagcaattggatgggttccatggcctgaaacagctgccgttcaacggcaagaagaccaagcctgcaaagcttcgcaaagactactggtcaccgctcgcccacattcgattccagcccggccaaggatccgtcggccgctcggtattccagaagctgcgagagctgaagcaccttcacgaggttgcatggacagacgagttgcgacataagcggccggaacagtacaccagccaggacaagaagaagattgccgaggagaaggaaaagggattcgattaccaaccaatccggagcaagcaggagcgtggaatcgctctcaacgcccagaagcaaaatgcgattgccgatatggcatccgttttggcgggcgaaggccgtggcaacaaggtcttgaccgcggaggctgaaggaggcgagaaagag

SEQ ID NO: 1048 - DNA, 371 bp, Artificial
  Synthetic
aataattcaatcttctacagctgcttcaactacaccacatcaagcatatcctcactttttgtctcacttcaaaacaccaaccatctcaacttattcaccatgtgtggcggaaactgcggctgctcttctacctctgcctgcagctgcggctccaactgctcctgctccagctgccactaagaacatgacttgaaactcgggcacatggcttgcatcacttgatgcttgagagaaatacggccaactgcatctacagcactggctcactcttctcaaattatactacacgacgacatatcaccaaatgcaattcaatgatggctagctagggcactttataatcaatgtatttttattgaactataattatt

SEQ ID NO: 1049 - DNA, 678 bp, Artificial
  Synthetic
cccacgcgtccgcccacgcgtccgctgagcgcacatcgcaagcatagaagccgtcatcagtcctccatttctcgatacctccagcgagttgatttcatcgcaacagcttactgcgttgtctgcctttttttctccgcttactcctgaaccccaacaaccaagatggcgaaccctctcgataccgatgctggctccgaacttttcagctcgtatgaggcggagctcaagctcgtacaggccgatctggcgcaaaagctggaccagatccccgaactgagtggtgaaccgcgcaaggctgccgtcagccaggctgaacgtgccctggaagaggcagatgaactgcttggtcaaatgcgccttgaaaagcaaaacatccctacatctgcacgagccaaagtcaaccagcgcttccgcaactacgagtccgacatcgattcaaaccgccgaaagcttacgggtctcgccactaaccgagcggccatgttcggttcacgctacaccgacgaaccatccggatcaacggatatcaatctggaacagcgacagcagttgctgtcagggaccgaaagactcgaccgaagcacacaacgacttcttagcagccagcggctcgccagcgagacagaggctatcggagctgaaacgttggccgatctgcacaggcagggcgagactatt

SEQ ID NO: 1050 - DNA, 718 bp, Artificial
  Synthetic
aaccaccacattttaccagttgcaacaagccactgaatcaatcagaaaaaccatcaaacaagacaatcggcatcaatctaaatatcgagcactcatcaatcgaaatgatgccgctgcacaggccggaaacgccacaacccgaatcccctcttcccaccgagcccgataccagcgagggcgacggcactgcggattactgaggggcaacacaagctcaaactttgatgacgacaagggccgctcgggaatgagagaatacgaccgagtctaaatggcactcaagagcggcgtcgaaatgctggttgcggaaacgaactggggaaacgacctagattgaatagacatgctcggagatggcgcatggaggaaacgtctatgaagcgcatgtctttttttggctttctttgttttttctttttacggccgacgacgacacgatacgccgataacatatacacttgcccccgccactgcccaaagagcgcgattctgcgggggtagcagttttatcagaatgaatgcggattggaattgagcgagcgatgtacattattttgtcttttatttgattgagaaattctttcaattttttacgcatttatcatttgccaatgttgttgttgctgttgttttcacggttaggcgttgtgagtgagctgtcaagagttccttgatctaatcagtatagcttcaatattaatcactttggcaacttccc

SEQ ID NO: 1051 - DNA, 375 bp, Artificial
  Synthetic
cacgaagcctaccaacgacgagctccttcgcctctacgctcttttcaagatcggcaagggcttcgatttggagtcggcccccaagcctggaatgttcgacatgaagaacaaggccaagtacaacgcgtggaaggccgctgtagaggaggagaacatcaccgaccccgaggaggcacagaagaagtatgttgagtttgtcgaggggctcaagtccaaatacgcctaatctcgacaagactcgaggattgaattagaagggggcacgctgcgagtgtaatacatggtactagagacgcatggcttttgggatagaatgccagttagcatgaagaaataaagtaaacaaattgtccacaaaaaaaaagaacagataac

SEQ ID NO: 1052 - DNA, 673 bp, Artificial
  Synthetic
ccaaaccgccaaacaacgcatcttacggcttcacaacagcttggaaagctctctattcgcaatggctatcgcaccgatcactggagtacgtccctattccggccaatggcgcagcgtcgcactgggaatcgtggcaggtcctgctataaattcattggagtagctaacacaggatgcagatgctgcggcgacagctcatccttgacctcggcgttggtcttggatccggattcatcatggccaactggtactggtacggctaccacatgccccgaaccaacggccgagacgcctactacgccaagaaggaggccgaccgtgccgccgcggcatcacagtaaggggggcacttgtatactcgatggaccgagagggaatgcggcatgaacaactgctggtcgaatagaaggggaatgactgggccaacgggctgttcatgcctgcaggagcatagttgctggacagatgtcgaatatcactgaagaaaggcaaccgggcgaacctctacttagaccaataagtcgcggggcaatacgattcaattatctcgattggcttattatatgtttttgccatgccgactcccctttgtttattgctgaaaatagtgctggtggtttctttccaattatgtacaaattatgtgctatacgaagccaaaaaaaaaaagaaa

SEQ ID NO: 1053 - DNA, 480 bp, Artificial
  Synthetic
gagttcaccaaaccgccaaacaacgcatcttacggcttcacaacagcttggaaagctctctattcgcaatggctatcgcaccgatcactggaatgctgcggcgacagctcatccttgacctcggcgttggtcttggatccggattcatcatggccaactggtactggtatggaacttgaaaatagtacggctaccacatgccccgaaccaacggccgagacgcctactacgccaagaaggaggccgaccgtgccgccgcggcatcacagtaaggggggcacttgtatactcgatggaccgagagggaatgcggcatgaacaactgctggtcgaatagaaggggaatgactgggccaacgggctgttcatgcctgcaggagcatagttgctggacagatgtcgaatatcactgaagaaaggcaaccgggcgaacctctacttagaccaataagtcgcggggcaatacgattcaattatctc

SEQ ID NO: 1054 - DNA, 434 bp, Artificial
  Synthetic
tactcgaccacgcgtcgaatggcgcagcgtcgcactgggaatcgtggcaggtcctgctataaattcattggagtagctaacacaggatgcagatgctgcggcgacagctcatccttgacctcggcgttggtcttggtaaatattggcccccgactgtccgcagagctttggcacagctatgcggctatttgttttattatccgctttgactcacgtttcgttataggatccggattcatcatggccaactggtactggtatggaacttgaaaatagcgagccgactccgatttgtcagggaataatgtctaataatgggataggtacggctaccacatgccccgaaccaacgggcgagacgcctactacgccaagaaggaggccgaccgtgccgccgcggcatcacagtaaggggggcacttgtatactcgatg

SEQ ID NO: 1055 - DNA, 611 bp, Artificial
  Synthetic
acaacagcttggaaagctctctattcgcaatggctatcgcaccgatcactggagtacgtccctattccggccaatggcgcagcgtcgcactgggaatcgtggcaggtcctgctataaattcattggagtagctaacacaggatgcagatgctgcggcgacagctcatccttgacctcggcgttggtcttggtaaatattggcccccgactgtccgcagagctttggcacagctatgcggctatttgttttattatccgctttgactcacgtttcgttataggatccggattcatcatggccaactggtactggtacggctaccacatgccccgaaccaacggccgagacgcctactacgccaagaaggaggccgaccgtgccgccgcggcatcacagtaaggggggcacttgtatactcgatggaccgagagggaatgcggcatgaacaactgctggtcgaatagaaggggaatgactgggccaacgggctgttcatgcctgcaggagcatagttgctggacagatgtcgaatatcactgaagaaaggcaaccgggcgaacctctacttagaccaataagtcgcggggcaatacgattcaattatctcgat

SEQ ID NO: 1056 - DNA, 631 bp, Artificial
  Synthetic
acgaacataaggccgacgcgtatcatttaacctcccgtcgacgtctatcattcaattctcgccgctttttgctcgcggtgaggatgtcgacaccggcgaggaagagactgatgagggattttaagcggttacagcaagatcccccggccggcatcagtggagctccgtatgacaacaatataatgctatggaatgcagtcattttcggccctgatgatactccctgggatggaggtacatttaagctgacacttcaattctcagaggactatccaaacaaaccaccaactgtgcggtttatttccagaatgttccacccaaatatttacgctgatggaagtatttgcttagacatcctgcaaaatcagtggagtcccatatatgatgtagctgctatactgacttcaatccagtgcagtctttgctctgtgatccaaatcctaactcgccagcaaattcagaagcagcacgcatgttcagtgagaacaagcgtgaatacaacaaggaggtgcgcgagattgttgaacagagctggacagcagactgacttctccctcactctcgtctgtgacagcagattatcctgtctcatactgaaattgttctcgtcttgtcactacattagtaacta

SEQ ID NO: 1057 - DNA, 584 bp, Artificial
  Synthetic
atttgatcggagggtgaatatgtcgacgccagcaaggaagaggttgatgagggatttcaaacgactgatgcaggatcctccagctggcataagtggggccccacaggacaacaatataatgctttggaatgctgtaatttttggccctgatgatactccttgggatggaggtacgttcaagctgacacttcagtttactgaagattatcctaacaagccacctacagtgcgatttgtttctcggatgtttcatcctaacatttatgctgatgggagcatatgcttagatatactacaaaaccagtggagccccatatatgatgtagctgctatactcacatccatccagtcgctgctttgcgatccaaacccaaattcacctgccaactctgaagctgcccgcctattcagtgagaacaagcgggaatacaaccgaaaagttcgtgagatagtggagcagagctggaccgcggactgatccactccatctaaccatatgatgcctgatacttaaaacgctcatcttttcagtgtgtcgtgtaccaaactgcttgtaattaaaatgctaaaacagtaaaacgtgc

SEQ ID NO: 1058 - DNA, 640 bp, Artificial
  Synthetic
cccacgcgtccgatctcttctattcataagttgtaaattcttattattgggattttttccctttttaattcaatccaagaattgagtaggactaatggcatccaggagaattcacaaggaactaagggagttgcaaagagaccctcctacttcatgcagtgcaggtccggtggcacaggatatgttccattggcaagcaaccattataggtccaaatgacagcccttatgcaggtggtgttttccaagtggccatccattttcctcctgattaccctttcaaacctcccaaggtggctttcaagaccaaagttttccatccaaatataaataataatggaaatatttgtttggacattcttaaggatcaatggagtcctgccctcaccatatcaaaggttttgctttccatatgttcactactaacagatccaaatccagatgatccattggttccagaaattgctcatatgtacaaatctgatcggaagaaatatgaatcaatggctcgtaattggacccaaaagtttgctatgaattgagttgttgtattcatataaagctcatgtgctataatttgtaacaaaagatcaatgattttctcctccgcaggcatgtaataaaagcacaaaattataaca

SEQ ID NO: 1059 - DNA, 840 bp, Artificial
  Synthetic
ttttaaatcgtaatacatatatacacaaaagtgaataattgagatggtttggtacaaagttgtttttttaaggatgttgggttacatcaaagcatggaatcacttaaatagttttggaaacacaagacatgaatgaaaagagaagaaagctgttgctgaatcgtgattgagagaaagtagagagagctacaacgcttacaacaaactactactagtcagcagtccagctttgctcaacaacatcacgcactctcctgttgtactcgcgcttgctttcgctgtacatccgagcagcttccgagtttgcaggagaattcggattagggtcacagagcaaggactggatggaggtaagtatagcagcaacatcatagattggactccactggttttgtagaatgtccaagcagatactcccatctgcataaatattaggatgaaacatccgtgacacaaaccgaactgttggtggtttattgggataatcttcagagaactgcagtgagagtttgaaagtacctccatcccatggtgtgtcatcaggcccaaatatgacagcattccagagcataatgttgttgtcctgtggagcaccactaatacccgcaggtgggtcttgctgcaacctcttgaaatccctcattaacctcttccttgctggcgtcgacatcctcctttctttcgtggaaacagatctcgttgttgaggtaaagatcgcggagagaagaggtcgtcaaacaaacatatgtgttcagcggtgttgaccgccggtaatcagagaaagttttccgatcgattcaggtcggcgattctcaatatcaccgtgcgcggacgcgtggg

SEQ ID NO: 1060 - DNA, 577 bp, Artificial
  Synthetic
attaattaactgcagtgctggcccagttgctgaagacatgtttcattggcaagctacaataatgggtccatctgatagtccttattcaggcggtgtctttctcgtaaccattcacttccctccggattatcctttcaaaccaccaaaggttgcattcaggacaaaagtgttccaccctaatgtcaacagcaatggaagcatttgccttgacattttgaaagaacaatggagtcctgcactcaccatatcgaaggttttgctttcgatatgttcattgttaacggacccaaacccagatgatccattggttccagagattgctcacatgtacaaaaccgatagagcaaagtatgagtctactgcgagaagctggactcagaaatatgcaatgggatgaaagtttgtgtcctttgatccctcacagactcggttttaatagagagagagagagaaagagagaggacttcttcacatagggatcttccatgaaataagttagattcctatgttttatcatctctttgtttgaaacctctttaatctcaaacaaaaacattacttcacctctttattatcc

SEQ ID NO: 1061 - DNA, 541 bp, Artificial
  Synthetic
ttgaatggagatcaaataatttcttactgatcctgtcttcacaaattttataagacagacaagtctataaaagatcattacatagaaataagaagagtttaattattagggctcttccttaaggacagtatttgtgtcagcccatggcatacttttgggtccaggtccgagcagtggactcgtacttgttcttgtctgtcttgtacatgtgagctatctcagggaccaaaggatcatctgggtttggatccgttaacaaagaacagatcgatagcagcaccttggaaattgtgagagcaggactccactgctccttcaagatgtcgaggcagatgcttccattgctgttaatgtttggatggaacaccttcgtcctaaaagccaccttaggaggcttaaatgggtaatctggagggaaatggatggttacaagaaaaactcctccagaataagggctatccgatggacccattatagtggcctgccaatgaaacatgtcttccgcaacgggtcctgcgctacatgaagtaggaggatcctt

SEQ ID NO: 1062 - DNA, 678 bp, Artificial
  Synthetic
gcgaactcctcccaagtcatatccctcaaagtcacagtatctcgtactttggtttctccttttgtttgggataagagaaagacagtaatgtcaggaggtatagcccgtggccgtcttgcagaggagcgcaaagcttggcgcaaaaatcacccccatgggtttgtagcaaagccagagacgctttcggatgggtcagttaacttgatggtttggcactgcagtattcctggtaaagcaggaacggactgggaaggcggtttttatccggttacgatacacttcagtgaagattatcctagcaaaccacctaagtgcaaattcccacaaggcttcttccatccgaatgtctatccatcaggaacagtttgcttgtcgatcctcaacgaagatagcggttggagacctgccattacagtgaaacagatactggttggtatccaagacttgttagatcagccaaaccctgctgatcctgcccaaaccgaagggtatcatctctttattcaggatgctattgagtacaagaagcgggttaggctgcaggccaagcagtatcctcctctggtgtagtctaaataatggtcgtatgtttggatcgtggttctaatgcaacttgaaactatggtattcatagcctgctgatagctgacagtcttctggcaaatgatgctgacttgg

SEQ ID NO: 1063 - DNA, 639 bp, Artificial
  Synthetic
gggcacctcctccaacacaaagcaggagttcaacgcagaatcaaaccaaaaccctagctcaccgccttgtttcctccgtattggtggttacaatgtcgactccggctagaaagaggttgatgagagatttcaagaggttgcagcaggaccctcctgctggtattagtggtgcacctcaagacaacaacattatgctttggaatgccgtgatatttggtcctgatgacactccttgggatggtggtacgttcaagctgactcttcaattctctgaggattaccccaataagccaccaacagtgcggtttgtttctcgcatgtttcatcctaacatttatgcagatggaagtatatgtttggatattcttcaaaatcagtggagtccaatatatgatgttgcagctatacttacatccattcagtcattgctgtgcgatcccaaccccaattcacctgcaaattcggaagcagctcggatgttcagcgagaataaaagggattacaaccgcagagttagagaagttgtggagcagagctggactgcagactgattctaaggaagaaagatgtcattgctgaccgcaattcgggagcaccagggttcatctatgttacatttacggattgaaacctcttctt

SEQ ID NO: 1064 - DNA, 615 bp, Artificial
  Synthetic
aatctccattgccttttaagccggcgacgaacataaggccgccgcctatcatttaacctcccgtcgacgtctatcattcaattctcgccgctttttgctcgtaggtcaacaattccgtatttcttatgcggtgaggatgtcgacaccggcgaggaagagactgatgagggattttaagcgattacagcaggatcccccggccggcatcagcggagctccgtgtgacaacaatataatgctatggaatgcagtcattttcggtcccttgatgcataacctccgctgggcactggaggtacatttaagctgacacttcaattctctgaagactatccaaacaaaccaccaactgtgcgaattatttccagaatgttccacccaaatatttacgctgatggaagtatttgcttggacatcctgcaaaatcagtggagtcccatatatgatgtaactgctatactgacttcaatccagtctttgctctgtgatccaaatcctaactcgccagctaattcagaagcagcacgcatgttcagtgagaacaagcgttgatacaacaggaacgtgcgcgagattgttgaacagagctggacagcagactgacttattccgcac

SEQ ID NO: 1065 - DNA, 625 bp, Artificial
  Synthetic
gaaaccaccgtccaccctacccaccctccgcagacctcttctcttgcgccgcgacccaaagaacaagaggatagctgaagaacccgaaaagaatgcagatggaagcccagaatgccgacccctttgctgaaaaccccgccaagctgcaaatgtcgggatccaactcaaacgacggccactcggtcaccaagcgcctgcaaaacgagctgatgcaactcatgatgtccgacacgcccggaatctcggcgttccccgtgtccgacgcagatctgctcaactggaccggcaccctgaccggcccggagggaacggtctacgaggacctgacgttcaaaatctcgctggccttcccccaaaactacccctacaccgcacccacaatcaagttcatcagccccatgtggcatcccaacgtggacatgtccggcaacatctgcctggacattctcaaggaaaagtggtctgccgtgtacaacgtgcagacaattctcttgtccctgcagtcgctgtttggcgagcccaacaacaagtcgcctctcaacgcccaggccgcccagctgtgggacacggacatggatgagtacaagcggctgctgatgcagcggtacgaggcccctgacgatga

SEQ ID NO: 1066 - DNA, 622 bp, Artificial
  Synthetic
tcctctctctctctctttaatctctggtctccgtctccgtgtccgtctccgttactgtgtctgtctcccttccgtcgagatctgtggatcttatagcctagccctaaaggggaacagcaagctttggactttccatggcctccaaacggatcctgaaggagctcaaggatctgcagagggatcctcccacatcatgcagcgcaggacctgttggggaagatatgtttcactggcaggcaacaatcatgggaccgaatgatagtccatatgctggcggtgtgtttatggtgaccattcatttcccaccggattaccccttcaagccgccaaaggttgctttcaggactaaagtttttcaccctaacatcaacagcaatgggagcatttgcttggatatattaaaagagcaatggagtcctgctcttacaatatcgaaggtcctgctgtcaatttgttcgctcctgacggatccaaaccccgatgatccccttgttcctgagattgcgcatatgtacaagacagacagagccaaatatgaaggcactgcaaggagttggacgcagaagtatgcaatgggctgaatctctgacctctctcgcccctttgtaataatcaaaagata

SEQ ID NO: 1067 - DNA, 679 bp, Artificial
  Synthetic
acgaccaccaattccaagcacacattcggacacccacactctctatcttgcgaacagcctgtcacgcgcgaaatcacttccccaacatcatcctggactacagtctccataacgacaccactcgcgcctcacatcccacgcatcactttccaacatgtccacagcagcgaggagacgcttgatgcgcgacttcaagcgcatgcagaccgaccctccagctggcgtctcagcctctccgatcgcagacaatgtgatgacatggaacgccgtgatcatcgggccctccgacacacccttcgaggatggcactttccgtcttgtcatgcacttcgaagaacagtaccccaacaagccaccgggcgtcaagttcatctcacaaatgttccacccaaacgtctatgccaccggagagctgtgtcttgacatcctgcagaaccgctggagtccgacatacgacgtggcggcaatcttgaccagcgtgcagagcttgctcaacgacccgaacaccagcagccctgcgaacgtggaagccagcaatctatacaaggacaaccgcaaagagtacactaagagggtacgggagacggtcgagaaaagctgggatgactgagcaaagcgcgcaacacgaaagtgagttatgaggcaatcactatcgaattcagactggcttgcatgagac

SEQ ID NO: 1068 - DNA, 467 bp, Artificial
  Synthetic
aaccaaaaataccatacaccatgtcgggcaagcgaccatctgtggcccagaagcggctcatgaaggagtacaagcagttcattagtgatcctccccagggaatcagtgcaggtcctgctgacgaagataactttctactctgggaatgtctgatacagggaccagatgatactccgtacgagggtggcctgttccccgcaacactcaaattcccccaggattaccccctgtcccctccagtgatgaagttcacctgcgaaatgtaccaccccaacatttacaaggacggaaccgtgtgtatttccattttgcatgctcctggtgacgatcccaacatgtatgagagcgcttcggaacggtggtcgcccatccagtcggtagacaagattctgctgtcggtgatgagcatgctagccgagcccaacgacgagtcaggggccaacattgacgccagcaaaatgtggcga

SEQ ID NO: 1069 - DNA, 654 bp, Artificial
  Synthetic
ttgacagtgtgtgttcttctttctcgcacttgttccgtgtgcccggggttagccctagggcgatctttgcgcgatccgggcaggggatcggggccgcggcgcatccacgcgggcgatgcgctagattgggcacccggcggcgaggatcagggtttggatttgtcggtagcaatagccctatcgatctccatcgatcgatcgagctgggcggcgggggaatgggcgagagccaggcgagcctcctcttgcgcaagcagttgaaagatttgacaagaaatcctctggatggattctcggctggattggtggacgattccaatgtgtttgagtgggcggtgaccatcatcgggccaccagacaccttgtatgaaggtggttatttcaacgctatcatgagctttcctctgaattatccgaatagtcctccgaccgtgagatttacgtcggatatgtggcatccaaatgtttacccggatggtcgtgtttgcatctccatccttcacgctcctggagacgatccaaatggctacgagctggcgagcgaacgatggtctccagttcacacggtagaaactattcttttgagtataatctcgatgctttcgagcccaaacgatgagtccccagccaacatcgacgccgctaaagagtggc

SEQ ID NO: 1070 - DNA, 705 bp, Artificial
  Synthetic
cgcgattgtagatgctatagatccaggtcgcctcgtcgtcgtcccgtggcgccgctgtagatagggtttgattcatcgcgcagcagcggcagcggcgatgtctacgccggcgaggaagcggctgatgcgggatttcaagcggctgcagcacgatccaccggcgggcatcagcggcgctccacaggacaacaacatcatgctgtggaatgcggtcatctttgggccggatgatacgccatgggatggaggaacattcaagctcaccttgcagttcacagaggattatccaaacaagccaccaaatgtgcggtttgtttcgaagatgttccatcccaatatttatgcggacggaagcatttgcctggacattctccaaaaccagtggagcccgatctacgatgttgctgcaatattgacatcgatccagtctctactatgcgatccaaacccaaactctcctgctaattccgaagccgcacgaatgtacaacgagaacaggcgagagtacaacaagaaagttcgccaagtcgtggagcagagctggacagcgaacgactgaaaccgagagttctgctcggctgctcgacatgctggtacgcgattttctggcgatcacggacggaattctactaaccagcaggagcactgtatatcctctgtactcggattttttttcttaggtgatgtggttgcaactaagaaagt

SEQ ID NO: 1071 - DNA, 653 bp, Artificial
  Synthetic
gggaacgcgggaaggggcggcaacggcgatggcgctggcgtcggcggcggccttgtgacagtcaaccacagcatgctcgttgcggctgccgccactgccactacagcgtcgatcgaattcttgtattcctgcaagctagggtggggcgagaatgctgtcgtcagcccagttgcggctcatgtccgacctcaaggcgattcaacaggagccgccagagggatgtagtgctagtccacaaggcgaagagaatctctttgtgtggggagccactgtgtttgggccggatgaaacaccatgggaaggggcgatcttgcctcttcgtctcacctttggcgagcactacccggcgaagccaccgcgcgtgagattcacgtccgaagtgttccatccaaatgtctacagtgacggcgcactgtgcatggatatcatccaggatgcatggtctccttgccacaacgtcagcaccattctcacctcgattcagtctctcctgactgatccaaatccagcgagtccagcgaatcccgaagccgcgcatatgtatcaaaacgatctccaagcatacaacaggagagtgcgccagtgtgtgaggaagtccctagatatataaaactccaaagttttatttatctatctatcatagtgattatcta

SEQ ID NO: 1072 - DNA, 802 bp, Artificial
  Synthetic
tactccatccaggaagcgcttgatgcgagatttcaagcgcctccagcatgatccacccgccgggatcagcggcgcgccgcaggacaacaacatcatgctgtggaatgcggtgattttcgggcctgacgatactccctgggatggagggacgttcaagctgacattgcagtttacggaggactaccccaacaaacctcccactgtgagatttgtttcaaagatgttccatcccaatatttatgctgacggaagtatttgccttgacatcctgcaaaatcaatggagtccaatctacgatgtcgcggccattcttacttccatacagtcattgctttgtgatcctaacccgaactcgccggccaactccgaggcagctcggatgtacagcgaaaaccgccgagagtacaacaggagagttcgcgacatagtcgagcagagttggacggcggagtagctccccttggttcaagagcttgtaagagtggccatcacagagagatgtgtgctgctccgagcacacataaagaatcttgtcaaaaaacaatccggaaagctgtcgcctctacagaccagcgttgaaggtcgaccatcgaactcgtttgcttctgttggaaccagggccagtgttctggtactcaccatagaacagggtgctgagagcgaagtccccgttccattccaaccatccacggggttgaattatgtcactgatgaacgacttcatgaacaccgtccgcgagtagagcttccacggccttccgagtttatgaaagacagccccgtgttctgtcgcttatcgacg

SEQ ID NO: 1073 - DNA, 581 bp, Artificial
  Synthetic
cgcgtcggggggaagggcgattagggtatatggcttgtcgcggctatggcgtccaagagaatcctcaaggaattaaaggacttgcagaaggatccgcccacttcgtgtagcgcaggtcctgtggccgaggatatgtttcattggcaagcgacgataatgggtcctcccgatagcccctacgcagggggtgtgtttttggtcaccatccatttccccccggattatccctttaagccccccaaggtcgcatttagaacgaaagttttccacccaaacatcaacagcaatggcagcatctgcctcgacattctcaaggagcagtggagcccggccttgacaatctccaaggtgctgctatcaatctgctcgttgctaaccgatccaaaccccgacgatccactggtgcccgagattgctcacatgtacaagacagacaggcccaagtatgaatcgaccgccaggaactggacgcagaagtacgccatggggtaagcccgggcttgtgagcggcggcggcggcggtggcggtggcatggctcgctatgatgtttgtgataccatttggttgcctatctataagt

SEQ ID NO: 1074 - DNA, 570 bp, Artificial
  Synthetic
cccacgcgtccgcccacgcgtccgctcacctggcgcgccgaagcttctctcctctctctcaactccggcgagaggaggaggcggcggtggggcgttcgtcgggagagagaccagggccggggggctagggttcggccgttcagagaggcggcggctgaggaggaggaggaggaggaggagggggtgaggagagatgtcgacgccggcgaggaagcggctgatgcgggacttcaagcggctgcagcaggacccgcccgccggaatcagcggcgcgccgcacgacaacaacatcatgctctggaacgccgtcatattcggaccggatgacacgccgtgggatggaggcacgttcaagctgacactacaatttacagaagattatcccaacaaaccaccagttgttcggtttgtctcaaggatgtttcacccaaatatttatgcagatggaagtatctgcttggatatcctacaaaatcaatggagccctatatatgatgttgctgcgatattgacctctatccagtccctgctctgtgatccaaacccaaactcccctgcaaactccgaagc

SEQ ID NO: 1075 - DNA, 556 bp, Artificial
  Synthetic
acgacaccaattttaaaaaatggctttgaagcgaatcaacaaggaactcagtgatcttggacgtgatcccccctcctcttgctctgctggtcctgttggccaggatctgttccactggcaggctactatcatgggaccctcagactctccttactccggaggtgttttctttctgtctatccacttccccactgactaccccttcaagccaccaaaggtgaccttcactacccgaatctaccaccccaacgtcaacaccaacggatccatctgtctggatattctcaaggagaactggtctcccgcactcaccatctccaaggtgctgctgtccatctgctccatgctcacagaccccaaccctgacgatcctctcgtgcccgacattggccacctgtacaagaacgaccgagcacgatacgacgccactgccaaggagtggaccaagaagtatgccgtctaggatgtatatagggagcaggcatgagcctatgcaagcgaatggctgtgacgatacaactagccaatgttagatttatggatggtaaaaaaaaaa

SEQ ID NO: 1076 - DNA, 519 bp, Artificial
  Synthetic
gcttttatcacttttgagaaccactcattcatccatctccgcaagatcgtctgtttttgtttacaatggattataccgaggataaccagaattctgctcctggcagcgtccaggcttccaagctcaatgccgctcgcaagggtcccgattcgcagagcgtcactaaacgactccagaccgagctgatgactctcatgacatctccagcacccggtatctccgcattcccctctgccgacggcaaccttatgtcgtggaccgccaccatcgagggccccgaggatacaccttattccggactcacgttcaagctgagcttcgcgtttccttcaaactatccttatgccgcgccgacggtcctcttcaagacgcccatctaccagcccaaagtcgacttctctggccgcatctgccttgacatcctcaaggacaagtggacagccgcctacaacattcagaccgttctgctgagtctgcagagcttactcggcgagcccaataacgcatctccattaaacg

SEQ ID NO: 1077 - DNA, 552 bp, Artificial
  Synthetic
ctcgtgtccgctgcgaagaaaaggggcatatcatggcattgaagcggatcctcaaggaactaaaggacctgcagaaagatcctccaacatcatgcagtgcaggtcctgctggtgaggatatgttccattggcaggcgaccattatgggtcctccagatagtccctatgctggtggagttttcttagtgaatattcatttccccccggactaccccttcaagcctccaaaggtatcttttaagacaaaggtcttccatccaaacatcaatagcaatggaagcatatgccttgacattcttaaggagcaatggagccctgctttgaccatttctaaggtgttgctttcgatctgctcgctgctcactgaccccaacccggacgaccctcttgtccctgagattgcccacatgtacaagacggatcgtccaaagtatgagacgacagcccgcagctggacccagaagtatgccatgggatgatgaaacccacaagccctgaattcaaacctgctgcttaaatgcagacagtcgtggtaattgtcccatgaaaact

SEQ ID NO: 1078 - DNA, 625 bp, Artificial
  Synthetic
aacaatccccagcctcaccaaaaaggacacaaaataacgacattcactctctctctctctctctcttcctcttttctccattctctcgcggggtcatccgcccaccatggcccaatccaccgcccaccgccgcctccttcaagaataccgcgccctcacaaacaacccgcccgaaggcatcaccgccggccccgtctccgaggacgacctgctgcactgggaatgcctcatccaggggcctgagggaactccctttgagggcggcgtctttcccgcagagctcaagtttcccaaggactatccgctggcgccgccgacgatgaagtttctcgctgacatgtggcatccgaacgtctaccccagcggcctcgtctgcatctccatcctccaccctcccggcgacgaccccaaccactacgagcacgcctccgagcgctggtcccccatccagtccgtcgaaaagatcctcatctctgttatgagcatgctagctgagcccaacgacgagagccccgccaacgtcgaggccgccaagatgtggcgcgagcgtcgggatgagtacgaaaagacggtccgcgacggtgttcggcgcatgttgggtttgtaacagcgcatgttgggtttg

SEQ ID NO: 1079 - DNA, 616 bp, Artificial
  Synthetic
cccgcacttcttccaacgtactggtgtactattattggcccaaaatcctcttccagctctgcaatctccgtctccgtcaattttcagtcaaccgaaatccaccatctttcattgttcatcaccttcaggttagggtttggatttgaaggtacaaggggctaattgatggcgtcgaagaggatattgaaggagctcaaggatctgcagaaggatcctcctacatcatgcagtgctggtccagtggcagaggatatgttccattggcaagcaactatcatggggcctacagatagcccttatgccggaggtgtatttttggtttcaattcatttccctccggattatcctttcaagcctccaaaggttgcctttagaactaaggttttccaccctaacatcaatagcaatggaagtatttgtctggatattctaaaagagcagtggagtccagcgttaaccatatctaaggtcctgctctccatctgctccctattgactgacccaaatccagatgatccacttgtaccagaaattgcccacatgtataagactgaaaggtctaaatacgagaccactgctcgtagctggactcagaaatatgctatgggataatggc

SEQ ID NO: 1080 - DNA, 662 bp, Artificial
  Synthetic
cccacgcgtccgcgatttctctatcatcatcatccatggcttcgcaagctagccttctccttcagaaacaactcaaagatctctgtaagcatcctgttgatggattctctgctggtctcgttgatgagaagaatatattcgaatggagcgttaccattatcggacctcctgatactctctatgaaggaggattctttaacgcgattatgacatttccgcaaaactatccgaatagtccgccaaccgtgaggtttacttcggatatgtggcatcctaacgtttattctgatggtcgtgtttgcatatctattcttcatcctcccggtgatgatcctagcggttatgagcttgcaagcgagcgttggactcctgttcatacagttgagagtattatgttgagtatcatatcaatgctttctggtcctaacgatgagtctccagcaaatgttgaagctgccaaagaatggcgagataagagagatgagttcaagaagaaagtgagccgttgtgtcagaaagtctcaagaaatgttttgatcaacgtcaaacttcacacctttgagatctctggagtttcaatcaaaagttcttcatattcctatctgaaaccctttgaaacgcaacttgttataactcggattacatctctttttgtcgcgttcg

SEQ ID NO: 1081 - DNA, 672 bp, Artificial
  Synthetic
ggttcaattctcgctaatcaggttaagactcatatttcttcgattgtttggttgggaatggcttcgaaacgaatattgaaggagctgaaggatctccaaaaagatcctcctacctcatgcagcgccggtcctgttggagaggacatgtttcactggcaagctacaataatggggccctctgacagcccttacgctgggggtgtatttttagtcactatccattttcctccagattatccattcaaacctcctaaggttgcttttaggacaaaagttttccatccaaatatcaacagtaatgggagcatatgcttggacatactgaaggagcagtggagccccgccttaactatttccaaggttttgctttcaatctgctcacttttgacggacccaaaccctgatgatccccttgttcctgagattgctcacatgtacaagacagacaaggccaaatatgaagcaactgccaggagttggacccagaagtatgccatgggctaactattgcctatggcggcttgaattgatataaagaaaaacaaatttcaatgtcctccttctatgctctctccattaacaagttgtataatagcattaagcattgccctctgcaggaagagactaatgatgctttgaattttgtttatataggtaataatattttatgcg

SEQ ID NO: 1082 - DNA, 711 bp, Artificial
  Synthetic
ggcgtcgattctctttgacactcgtgccgcttcatcactcaggcggtcagggatgtcgacgccagcgaggaaaagattgatgagggattttaagaggttacagcaggatcctcctgccggcatcagtggtgctccgtatgacaacaatattatgctctggaatgccgttatattcggtcctgatgacacaccttgggatggaggtacgttcaagctcacccttcagtttacggaggactaccccaacaagcctccaactgtgcggtttatttccaggatgttccatccaaatatttacgccgatggaagtatatgcttggacatactgcaaaatcagtggagtcctatatatgacgtagctgctatacttacttcaatccagtctttgctctgtgatccaaacccaaactcgccagcaaattcagaagcagcacgcatgtttagtgagaataagcgcgagtacaacaggaaggtgcgtgagattgttgagcagagctggacagcagactaacatctctcaggctgaatctgttttgggagattttcctggtaccgcctgtgtcgagctgaaaacttttcagtgccgttgctacattaaaaacaaatgtagcaggaaattgtacttttatgtgttgtaggaaactctgattgcctttatcttcatgttctgctactcgactatgagacgttgtacatatgatgatctcttgt

SEQ ID NO: 1083 - DNA, 638 bp, Artificial
  Synthetic
caaattcttaaaactatctccactatctctttctctctctagacaaattaagaacccttagcgtaaactctgcgaccgaagaaccccacccacccaggcagccttcaattcaattccaatggcgaacagcaatcttcctcgccgaattatcaaggaaactcaacggcttctcagcgaacctgcaccaggaataagtgcatctccatcggaagataatatgcgatactttaatgtcatgattcttggtcctacacagtctccttatgaaggaggcgtcttcaagctcgaactctttttgcctgaagagtacccgatggctgctcctaaggttcgattcctcaccaaaatctaccatccgaacattgataagcttggaaggatatgtcttgatattcttaaagacaagtggagtcctgcacttcagatccgtactgtacttttgagcattcaagcacttttgagtgctccaaatccggatgatccactctctgagaatatcgcaaagcactggaagtcaaatgaggctgaagctgttgaaacggctaaggagtggacacgcctatatgcaagtggtgcatgaaggcattagcaacgaaatatttaaaaataacaaaaattatggactgtatcctattgac

SEQ ID NO: 1084 - DNA, 561 bp, Artificial
  Synthetic
ctttcataatggacagcaggagatgcaaatgcaagtggtgcgggacgaaaatttcagctcccattggagcacaaaccatttcgtgcccaaggtgccaatctgttacccaactccaacctccaagaaccaacaacggctttgccgctggggttattaacaatattatgggtgcagtagttaacacagggtttccagcaaggctgggaaggatgaatccaacagatgccaataattatcagcctcaaccgttcaacatgtcaccccagattactatgcaacctccagctgttcatggacggaagcgagcagtactctgtggaataacctaccgtgggcattccaagagtctgaaaggaagtattaacgatgttttatccatgagatatcttctggttcagaagttgggtttccccaatgcatccgttcttgtccttacagaggatgagaaagatccatacaaaatcccaaccaagggcaatatcagatcagccctacgttggcttgttcatggttgtcagccaggagattcactagtgttccactactctggccatggcacac

SEQ ID NO: 1085 - DNA, 632 bp, Artificial
  Synthetic
tcgaccacgcgtcggcaaaacatcctccgtgcaatgcactggctggtcaaggatgccagacccaatgactctctcttcttccactattccggccacggtgggcaaacaaaggatcttgacggcgatgagcctgatggatatgacgaagtcatttaccctgttgatttcaggcaacatggacatatcacagatgacgagatgcaccgcatcatggtcacccccctccaggcaggtgtaaggctgacagccatcttcgattcgtgccattctggcacagcactcgacctgccatacatctattctacacaaggtatcctcaaggagcccaacttggccaaggaggccggccagggcttgctcggcgtcatttcctcgtacagccagggagatctcggcggtgttgccaacaacatcatcggtttcttcaagaaggccaccacttggcgaaaaagcccacaaccgggccctcgcaaccaagacttctcctgccgacgtcgtcatgtggtccggaagcaaagacgaccaaacctctgccgatgctaccattgcttcacaagctactggtgccatgtcctgggcgtttgtcacggcgcccaggaagaaccccagcagagctacgtccagctgctcaa

SEQ ID NO: 1086 - DNA, 647 bp, Artificial
  Synthetic
cccacgcgtccgcccgcctcagcatggaggatatggaccacctcagcctcaatacggcggccaccagaaccaatatcctcctcccggcggccctcccccgagccactacgcacctcctgcgcaccatcctcctccgggtctagatgcttacggctatcctctcaaccctccgactgccatgcacgcaaaggccggccccccgcctccctcggcccctcagcagtttggccacggtgctccgggcggctacaccttccagtactccaactgcacaggaaagcgaaaggcgctgttgattggaatcaactattttggcacaaaggccgagctcaagggatgcatcaacgatgtccacaacgtgtcggcattcttggttgagcgatatggctataagcgcgaggacatggtcatcctgacagatgaccaaagcaaccctgtcatgcgcccaaccaaggccaacatcgtccgtgccatgggatggcttgttaatggcgcccagcccaacgatgcccttgttccttcactattctggccacggcggccagaccgaggacaaggacggcgacgaagacgacggctacgatgaagttatataccccgttgactttgaacaagctggacatcttgtagatgatgagatccacttc

SEQ ID NO: 1087 - DNA, 619 bp, Artificial
  Synthetic
gaatccccaccatcttcatcaccaaaaatgggtggggtaatcagatctcaacgtaagggagctggttccatcttcaaatcccacacccaccaccgcaaaggaccagcaagattcaggagtttagatttcggtgaaagaaatggttacttgaaaggagtagttacagaaatcatccacgatccaggacgtggtgctccattagctagggttactttcagacatccattcaggtacaagcatcagaaggagccttttgttgctgctgagggtatgtatactggacagtttttgtattgtgggaagaaggctaatcttatggttggaaatgttcttccattgagatctatccctgaaggagctgtggtttgtaatgttgaacatcatgttggtgatagaggaacattggctagagcttctggtgattatgctattgttatcagtcacaaccctgataatggtacttcaaggatcaagcttccatctggagcaaaaaaagattgtaccaagtggatgccgtgctatgattggtcaagttgctggtggaggtaggactgaaaagcccatgctgaaagcaggaaatgcttaccacaaatacagagtgaagagaaactcctggccc

SEQ ID NO: 1088 - DNA, 689 bp, Artificial
  Synthetic
agcggccggactcagctacccgtaacatcgcagccagcgacgtcgagtcaccatgggtagagttattcgcaaccagagaaaaggccgtggctccatcttcacggccaacacccgcctgaacaaggctcccgccaagttccgcaccctcgattacgccgagcgccatggctacgtccgtggaatcgtgaaggacatcatccacgaccctggtcgtggtgctcctctcgccaaggtccagttccgccacccttataagtataagcaggtcaccgagaccttcatcgccaacgagggcatgtacaccggccagttcatctatgccggaaagcgcgctgctctgaccgtcggcaacgtcctgcccgtcggtgagatgcccgagggtaccgttgtctccaacgtcgaggagaagattggcgaccgtggcactctcggccgtaactctggtggctacatcaccattgttggccacaaccccgatgagggcaagacccgtatcaagcttccctctggtgccaagaaggtcgtccactcccgatctcgtggcatgatcggcatcgttgccggtggtggccgtaccgacaagcctctgttgaaggcttctcgtgccaagcacaagttcgctgtcaagcgtaacagctggcccaagactcgtggtgttgccatgaaccccgtggaccacctcaccgtgg

SEQ ID NO: 1089 - DNA, 655 bp, Artificial
  Synthetic
gcgaggaagcagcaatgggtcgcgtgatccgggcacagcgtaagggtcgctggctccgtctttaagtcgcacacgcaccaccgcaaggggccggcgcggctgcggaagctcgacttctcggagcgcaatggctacatcaagggcgtggtgacggagctgatccacgacagcgggcgaggggcgccgctctgcaaggtgacgttccgttaccccttccggttcaagcaccagaaggagctcatgatcgcggccgagggcatctactcgggccagttcatgtactgcggcaagaaggcccagctcgccattgggaatgtcctgccgctgcggtcggtccccgagggagcagtcgtttgcaatgtcgagcaccgtgtcggggacaggggttcattcgcccgggcctctggggactacgcgattgtagttagccacaacccggatatgggaacctcacgtatcaagcttccgtctggcgccaagaaaatcgtccccagcggctgccgcgcgatgatcggtcaggtggcgggcggtggcaggaccgagaagccgctgctcaaggccgggaacgcgtaccacaagttccgcgtcaagcgcaacagttggaccaaggtgcgtggtgtggctatgaatcccgtggagcatccccacggaggag

SEQ ID NO: 1090 - DNA, 669 bp, Artificial
  Synthetic
ctccttagtatcatttcctcaactcctctggcgagagagagagagacggcgaaatgggtcgtgtaatcagagctcaacgtaagggagcagggtccgttttcaaatcccacactcaccaccgtaaaggtccggcccgattccgtaccctcgatttcggcgaacgtaatggttacctaaagggagtaatcacagaagtgattcacgatcctggtagaggagcaccactcgcgcgcgtgacattccgtcacccgttccgttacaagcaccaaaaagagttgttcgttgctgctgaagggatgtacactggtcagttcgtttactgtggtaaaaaagctactcttatggtcggtaatgtgttgccgctcagatctataccagaaggagctgttgtatgtaacgtggagcataaagtaggagatcgtggtgtttttgctagaagctctggtgattatgccattgttatcagtcacaaccctgataatggtaccactagagttaagcttccatcaggagccaaaaagattgtacccagtggatgtcgtgccatgattggtcaagttgctggaggaggacgtactgagaaaccaatgctcaaagctggtaatgcttaccacaagtaccgggtaaagaggaactgctggcctaaggtccgtggtgttgctatgaatc

SEQ ID NO: 1091 - DNA, 746 bp, Artificial
  Synthetic
cccacgcgtccgctcaaaaccctaatatctgaacttcgccgtcgagagcatccatgggtcgtgtcatcagagctcaacgtaagggtgcgggttccgtcttcaaatcccacactcaccaccgcaaaggtccggctaagttccgtagcctcgatttcggcgagagaaatggttacctcaagggcgtcgtgacggagatcatccacgatcctggtcgtggtgctcctcttgctcgtgtcactttccgtcatcctttccgtttcaagaaacaaaaggagctcttcgtcgccgccgaaggtatgtacaccggtcagttcttgtactgcggtaagaaagctactctcgtcgttggaaatgttctccctcttagatctattcctgaaggagctgttgtctgcaacgtcgagcatcacgtcggtgatcgtggtgtcctcgctagagcttctggtgattacgccattgttatcgctcacaaccctgacagcgacactactaggattaagttgccatcgggttcgaagaagattgtcccaagtggatgcagggctatgattggacaagttgctggaggtggaagaactgagaagccgatgctcaaggcaggaaacgcgtaccacaagtaccgtgtgaagaggaactcatggcctaaggttcgtggtgtggctatgaatccagtggagcatcctcatggaggaggtaaccatcagcacattggtcacgccagtactgttaggcgtgatgcacctcct

SEQ ID NO: 1092 - DNA, 771 bp, Artificial
  Synthetic
cgttatttattatgcatcttgactacccctcgaccacgcgtccggccgagcaagctcgagagagggagagagagagacggcgaaatgggtcgtgtgatcagagcacaacgtaagggagcagggtcagtcttcaagtcccatacccaccaccgtaaaggccctgcccgtttccgttccctggacttcggcgaacggaatggttacctcaagggtgtcataacggaggttattcatgatccaggtaggggtgccccattggcgcgtatcactttccgtcacccgttccgttacaagcaccagaaggaactgttcgtggctgctgagggtatgtacactggccagttcgtttactgtgggaagaaggctactctcatggttgggaatgttctcccactcagatctgtccctgaaggagctgtcgtttgcaatgtggaacacaaggttggtgaccgtggcgtttttgccagatgctctggtgattatgctattgtcatcagtcacaaccccgataacggaaccactaggattaagcttccatcaggatccaagaagattgtgcccagtgggtgtcgtgccatgattggtcaagtagctggaggaggacgtactgagaaaccaatgcttaaggctggtaacgcataccacaagtaccgggtaaagaggaactgctggcccaaggttcgtggtgttgccatgaaccctgtggaacatcctcatggtggtggtaactatcaacatattggtcatgctagtactgtccgtcgtgatgca

SEQ ID NO: 1093 - DNA, 551 bp, Artificial
  Synthetic
gagagagagagagagagagagagagagagagagagaggggtaggtaggaaagggtagcagcagcagcaatgggtagagttatcagggctcagaggaagggagcaggttccgttttcaagtcccacacgcaccggaggaagggccctgccaggtttcggtccctcgactatgcggagcgcaacgggtacatcaagggcgtcgtgtcggagatcgttcacgactctggccgcggggcgcccctctgcaaggtcaccttccgtcacccgttccggttcaagcaccagaaggagctcttcgttgccgccgagggcatctactccgggcagttcctctactgcgggaagaaggccaccctctccatcggaaacgtgctgccgctcaagtcggtccccgagggggccgtcgtctgcaacgtggagcagcgcgttggggaccggggtgctatcgccagggcctccggcgactacgccatcgttgtcagccacaaccccgacaacaatacctcaagaatcaagcttccctccggtgcaaagaagattgtccctagcgac

SEQ ID NO: 1094 - DNA, 379 bp, Artificial
  Synthetic
gccgataatcaacaatgggtcgtgtcattcgaaaccaaagaaagggtgctggttctatcttcaccgcccacacccggctccgaaagggcgctgccaagctccgagatctcgactacgccgagcgacacggatacatccgaggtgttgtcaaggagatcatccatgaccccggtcgtggtgctcccctcgccaaggtcgtcttccgagacccctacaagtacaagcagcgagttgagaccttcattgctaacgagggtgtctacactggccagttcatctacgccggtaagaaggctactctgaacgtcggaaacgttctgccccctgggctctgtccccgagggtaccatcctctccaaacgtcgagggagcacgccgg

SEQ ID NO: 1095 - DNA, 958 bp, Artificial
  Synthetic
aaacagagaacgccgaaatgggtcgtgttatcagagcacaacgtaagggagcaggctccgttttcaaatcccacactcaccaccgtaagggccctgccaaattccgttcactcgattacggtgaacggaacggttaccttaaaggtgtggtctcagaaatcatacatgacccaggtaggggtgcaccgttggcacgcgtaacattccgaaacccgttccgttacaagcaccagaaagagttgttcgttgctgctgaggggatgtacactggtcagtttatttactgtggtaaaaaagctaatctaatggtgggtaatgtgttggcacttagatctatccctgaaggtgctgtcgtttgtaacgtggaacacaaagttggtgaccgtggtgtttttgctagatgctcaggtgattatgctattgtcatcagtcacaaccctgataatggaactactaggattaagcttccatctggagcaaagaagattgtgcccagtgggtgtagagccatgattggccaggttgctggtggaggaagaactgagaaaccaatgctcaaagctggaaatgcataccacaaataccgggttaagaggaactgctggcctaaggttcgtggtgttgctatgaatcctgtggagcatcctcatggtggtggtaaccatcaacatattggtcatgccagtactgtccgccgtgatgcaccacctggacagaaggttggtcttattgctgcaaggagaactggtcgtcttcgtggtcaagctgctgctactgctgccaaggctgacaaggcttaagatattaagtttgttacttttttcattgtcgttgtattctgatcggatttgagaccgtctttatactaagttctgtttggatattatttagtaaggtttgtttaggaaccctcgtttggacaagtttgccacttataaatgtgttttagcttggctct

SEQ ID NO: 1096 - DNA, 385 bp, Artificial
  Synthetic
tttgacttccttgacggcaaggttgcccgatggaggaagaagagcagcctcatgggccaggagctggattcccttgccgacttgatctcgtttggtgtcgcccccgccatggtggccttttcaattggtcttcgaactactgtcgataccgtcggcctcaccttcttcgtcctgtgcggcctgacccgactggcccgcttcaacgttaccgtcgcggttttgccaaaggacgccagtggcaagagcaaatatttcgagggcacccccattccgacgtcgctgggcctggatgccatcatgggctactggctgaagcagggcttgatattggacaacattccgtttggcaccttgcttgagggcactccgctcgagttccaccccg

SEQ ID NO: 1097 - DNA, 553 bp, Artificial
  Synthetic
tcctgttcggtcgcagatcaaaagttcagacgacacagtctttgtttctttttcttttacaattgtacaaaagagaaaagatcttctatttaaagggatcaattggtgttgggacgcgaatctacgaagaggcgcatataatacaaaaggggcttccaacatccagccatgaagttcacgactctcctcttccttctaccagccgtcctcgctcttccaaccgagcaggcgcaagactccaatgccatcgatgcgagccgcagtttccactgccccgacaaagtccagggcttctgctccgcgtccaacatcaaatcgggatgcagctcagacggaaagtttcattccgaggccatggatacatgcagcgagtgttcatgtgattgagtggtggtggttacggtgatttggtggtataatcatagtacatggacgggtttcacgtgcttcttgttttgtcaatgctgcgagtttgatgcgagttccttgctagctgcttagattgttctaattactgtcagtggaaaatgtaaattgagcatcagtctattac

SEQ ID NO: 1098 - DNA, 246 bp, Artificial
  Synthetic
cgatccagtaagacatcacgcagcgaaaagttaaacgtttgggcgcaaatgtatggattgtattactaaaaaattgcagtatcttcttgcatgtccctgcatgggagaataaaccttcatccctttgagcgcgcctcatctagtggggaaccgggcagaggtcggagaagagatggaagtggaagtgggctttaacacggaggagcagaatgtatatcagttaggctgtcacagtcacatgcgaca

SEQ ID NO: 1099 - DNA, 735 bp, Artificial
  Synthetic
cccccccgaatccaatctccgcctaggggggttgctgccgagccactcccctcgttccagttaagctttcagctccttcaactccacagccatggccgaacagacggagaaggcgttcttgaagcagccaggtgtttttcttagctcgaagaagacagggaaggggaagagaccagggaagggaggtaaccgctacttcaagagcattggtctagggttcaagactcctcgcgaggctattgaaggtacgtacattgacaagaaatgtccatttactggaaatgtttcaatcagaggtcgtatccttgctggtacatgccatagtgccaagatgaacagaaccatcattgttcgtcggaactacctgcattacgttaagaagtaccaaagatatgagaagaggcattccaatatcccagctcacatatcaccttgcttccgtgtgaaagagggagatcatgttatcattggacagtgcaggcctttgtccaagactgtgaggtttaatgtgttaaaggtgattccagctggttctgctggtggtggcaagaaagcatttacaggaatgtgagcaggtgtttcttgagtttactgtcacttctagagtatgaaagtaattatgcttgagactgagaagaggagtgacgttgagacttctctactaaaagctgtttgcgtttgcctttgaaggcttaaattttgtatggatacttgctacctatcattagtataagg

SEQ ID NO: 1100 - DNA, 237 bp, Artificial
  Synthetic
aatcagtagccatggctgagcagactgagaaagcttttcttaagcaacccaacgtcttccttacctcgaagacatctgggaaaggaaagagacctggtaaaggtggaaaccgtttctggaagaacattggtttgggcttcaagactcctagagaagccattgatggagcttacattgacagtaaatgcccattcactgcaaccgtttctatcagaggacgtatcttacctggtactt

SEQ ID NO: 1101 - DNA, 685 bp, Artificial
  Synthetic
  misc_feature (621)..(621): The residue at this position can be any nucleotide.
tagggttttgccgccgtgcatctatcctcgtccagttcagcttgtagtcctcaatcatggcggagcagacggagaaggcgtttttgaagcagccaggtgtttttctaagctcgaagaagacagggaaagggaaaaggccaggaaagggaggcaatcgctactttaagagtatcggtctagggttcaaaactcctcgtgaggctgttgaaggtacatacattgacaagaaatgcccattcactggcaatgtttctatccgaggtcgtatccttgctggtacatgccacagtgctaagatgaacagaaccatcattgttcgacgcaactacttacattatgtcaagaagtaccagagatatgagaagaggcactcaaacattccagcgcacatctcaccatgcttccgtgtgaaagagggagatcatgttatcattggacagtgcaggcctttgtccaaaaccgtgaggttcaatgtcttaaaggtgattccagctggttctgctggtggaggaaaaaaggcttttaccgggatgtgagctttgtgcttccatttcaactgttatttctaggaatgatgtcaagacttttctgcttttactgaattgttgccttcattgattntcctttgaacatcaaattttgtaacttaaatcttagcaattttttttaagcctatgtactactc

SEQ ID NO: 1102 - DNA, 660 bp, Artificial
  Synthetic
acgcgtcgcttctaggttttaggtttaggaggaagaagaggaggaggagaggagcgccgtaggccagcagaggaggagcaaggcgatggcggaacagactgagaaagcctttttgaagcagccaaaggttttcctctgtagtaaaaaaacagggaaaggcaaaaggcctggaaagggtggaaacaggttttttaagagcataggattgggcttcaagactccaaaagaagccgttaatggtacttatattgacaagaaatgcccattcactgggaatgtttcaatccggggtcgaatcctcacagggacggtccactgtgcgaaaatgactagaaccattattgttcgaagagactatctccactttgtcaagaagtatcaaaggtacgagaaaaggcattctaatcttgctgcccatgtttcaccttgtttccgagtcaaggaaggcgataaggttatcattggacagtgcaggcccttgtctaagactgtcaggtttaatgttctgaaggtaattccaatggggtcatctgatggaggaagcaaaaaatcatttgcaggaatgtaagcgtagtcactatctgcactagatgtagtggtcatacatttgcagggatttagcagatttttccattgggcttttgtgccgctggttcatga

SEQ ID NO: 1103 - DNA, 522 bp, Artificial
  Synthetic
gaccagcaaaatgtccgagcttcacgtccagaacgagcgagctttccagaagcaacctcacatcttccagaacgccaagtccaaggtcaaccgaaagaccaagcgatggtataaggaggtcggtctcggattcaagaccccctctgccgccatcaccggtgactacattgacaagaagtgcccctttgttggtgacatttctatccgaggcaagatcctgactggtaaggttgtctccaccaaaatgcacagaaccatcatcatccgacgagagtacctccactacatccccaagtacaaccgatacgagaagcgacacaagaacctcgctgcccacgtctctcccgctttccgagtcgagaacggcgatatggttaccgttggtcagtgccgacctctctccaagaccgttcgattcaacgttctccgagttctgcctgccaccggtaaggctaacaaggccttctccaagttctaaacttgaaaaaatctagtaagatattgtattaaaaatcgtcaagc

SEQ ID NO: 1104 - DNA, 511 bp, Artificial
  Synthetic
ggtgtagattttgttaaaatcagggttagggtttatcagcgggcggctagaggagcaaaagaagcgccatggcggagcagaccgagcgcgcgttcctcaagcagccgaaagtcttccttctcgccaagaacactggaaagggaaagaagccaggtaagggcgggaatcgattctggaagaacgttggattgggcttcaagaccccgcgggaggcaatcgaagggacttacatcgacaagaaatgtcccttcacgagcaatgtgtccatccgtggacgtattctctctggaactgtggccacgaccaagatgacccgcagtatcatcgtgaggcgggattacctgcactacgtgaagaagtaccagcggtatgagaagaggcactcgaatgtggctgctcatgtctcgccgtgctttcgcgtgaaagaaggtgaccaagtgatcatcggccagtgcagacctctctcgaagacgattcgcttcaacgtcttgaaggtgatgccgagaggagc

SEQ ID NO: 1105 - DNA, 858 bp, Artificial
  Synthetic
atctctccggagcaggataattcaagatggcgaccgagttgaccgtccagtcggagcgtgctttccagaagcagcctcacatcttcttgaactccaagaccaagaccaagagcgcccgaccgggtaagggaggacgacgatggtacaaggatgttggtctgggtttccgtacccccaagactgccattgagggcagctacatcgacaagaagtgccctttcaccggtctcgtctctatccgtggccgtatcctgaccggcaccgttgtttccaccaagatgcaccgaaccgtcatcatccgaagagagtaccttcactacatccccaagtactctcgttacgagaagcgacacaagaaccttgccgcccacgtctctcctgctttccgtgttgaggagggtgaccaggttaccgttggccagtgcaggcctctctccaagactgtccgcttcaacgtcctccgcgttctgccccgaactggcaaggcggtcaagtccttctccaagttctaaattgggtttctctactggcatttttggcgtgataaacatcgggggggaacgaatcatccccgctggagggtcggcatgggaagttgctttacaaaatgagttgtagacgcaatcgtgaataaaaaaggattcatgaccacgatctcgacgtctcagggttgtttacgacgcttaattcgattcccaatcacggagcccggtgcaaaaaagaaatcttgatgaggccctcaggtgatgaatgaataaaaacccaatgtttaaatatcaacaacaggtctcatggtacagcggaagcagtgattgtacaacagagaaaatatcgcgtgatatcaatgcacacggcata

SEQ ID NO: 1106 - DNA, 645 bp, Artificial
  Synthetic
cccccggccgccgcatcctccttcgcaagcctcgcctccactccccgcgccgccgccgccgccgccgactcgccggtcgtcaccctcgccccgcagccatggctgagcagactgagaaggctttcctgaagcagccaaaggttttcctcagctcaaagaagtctggcaagggtaagaagccaggcaagggtggcaaccgcttctggaagagcattggccttggcttcaagacccccagggaagcaattgaagggacatacattgacaagaagtgcccattcactggaactgtttctatcagaggcagaatcattgctggaacatgccacagtgccaagatgaacagaactatcattgttcgcaggaactacctccattttgtcaagaaatatcagaggtatgagaagaggcattccaacattccggctcacgtctccccatgcttccgtgtcaaggaaggtgaccatgtcatcattggccagtgcaggccgctgtcgaaaactgtgaggttcaacgtcctgaaggtcatcccagctggatccaccggcggcagcggtggcaagaaggcctttaccgcagcctgagcttgtactctcatattcatgggtagtttataggcagatccttttgcttgaagtcctggca

SEQ ID NO: 1107 - DNA, 605 bp, Artificial
  Synthetic
cgcgccagtgcgtctcttggtcgcgcggcgatcatggcggagcagactgagagggcattcttgaagcagcctaaggtttttctctgtcctaagaaaaccaccaaggggaagaagcctggcaagggcgggaataggttctggaagaacattggccttgggttcaagacacccagggaagccatcgaaggaacctacattgacaagaaatgcccattcactggtactgtatcaattaggggtcgtatcatagctggaacatgccatagtgctaagatgaacaggaccattattgttcggaggaattatctgcactttgtcaagaagtaccagaggtacgagaagaggcactccaatattcctgctcacatttcaccgtgcttccgtgttaaggaaggagatcacgtgatcattggccagtgcaggccactgtcaaagaccgtgaggttcaatgtgctgaaggtcattccggcagggtcaaagagtggtgcagggaagaaggttttcacagccgcttaagatgtatatgaggagatattcagggttctgaaagctttgatcatgagattttgatgccacctagatgtctttctcgtgtctaccatctt

SEQ ID NO: 1108 - DNA, 648 bp, Artificial
  Synthetic
attttacataggagcgtttctcgttcgcgtccattttcattttgcgtctacagcgaagcgatactcttccagcactacgcgatacccccttttgtctatactcacaccaccaaacgtagcgacaagcacagcgacgcaacatttacaatgagcgcaagaagcggagcgaaacgactcatcaaggagcttgagagctggcgcaaggagcgcaaggacgaaaagggcgtggagaggctgggtccgatcaatgaggatgatttattcgagtgggaggccgtcatcaacgggagggagattggatcgggctatgatgagggccgctggctcatacacatccaaatccccgcgcagtatcccttgcagccgcccaagatgcgcttcgtgacgaccattgtgcaccccaacattgcgctgcagtcgggcgagatctgcctcgacctgctcaaggacaagtggacgccgacgtacagcgtgctgcagtgcgtgcgcgccgtgcgcatgctgctgagctatcccgagacggacagcccgctcaacgtcgatgtcgcggcgctgcttagaggaggcgatgttttggggacgcgaaagctggtgcaatattggtgctcggagccggagggaagatatgatggcccgtaagggggtgtg

SEQ ID NO: 1109 - DNA, 690 bp, Artificial
  Synthetic
atcataagtggggcaaaaaaagggttcatggcgaaggcgcacgaatccactgcggcactccccttcttgatcgattaggtcagatcgaagtaggtcgatcgattgatagatagattggaaagggatcggcgaagatgctcgatgtgtcccgcgtccagaaggagctggtggagatcgagcgcgacaagaagctgtcgggcgtgagcattcaagtcttcgacgatgggttgagtcgaatgcgaggaacaatcacggggcctgttggcaccccctacgagggcggaatcttcaccatcgatattcagttaccttctgcttatcctttcgaaccaccaaagatgcaattcatgactaaagtctggcatccaaacatcagcagccaaaacggagctatctgcctggacattctaaaggatcagtggagtccagcgctgacgctaaagactgcgctactgtcgctacaagcgctgctttcgacgccggagccgggggaccctcaagacgcggtcgtcgcaaagcagtacctgagtgagtatccggttttcgagagcactgcgagatactggaccgaaacgtttgcaaagagatcgtcccttggcatggaagaaaaggtagcgaagctagtcgagatgggatttacggatgaggttgcgaccgctgctctagagtgctgtggcggcgacgagaatg

SEQ ID NO: 1110 - DNA, 662 bp, Artificial
  Synthetic
aagcctcttcgaccaccctctgccatcgtcagccttcgactctcttcaccaaacctcaacaagcgacaaattatcgccagggtgctccaacgctcgctccgccatcgccagtatcctttggacccatactttcgctctacaacacacacaacccctcttacgcccacatagcttcggctacgtcaagtttcggcatcatgtctagcagagatcgccgtataatgaaggagctgcaggatctgaccgaggacaaggacacttccggcattcatgctgccctagaacaagagggctcgctgaccgctctcaagggctggttctttggccctggaaatacgccgtacgctggtggcaaattcgtgattcacattcagcttcccaccgactaccccttcaagccacccaagatgaagtttgagaccaggatctggcatcctaatgtcagcagtcagacgggcgtcatttgtctcgacaccctcaacaagaactggtcgcctgtccaaacgatcaagacggctctcctctccgtccgaatgcttctcgaaaacccaaacccctcagatccacaggacggcgaagttgcacggatgctgctcgacagtcccgactcgtttgtccagatggctcacgagtgggcagtcaggcacgccggtgcgccgcga

SEQ ID NO: 1111 - DNA, 634 bp, Artificial
  Synthetic
gggctctgcaacaaccaaggacaactcgcaagagagaatatggcgaccaagcgtgatgccgccgcaacaccggcagcaccggtacgagggccggccgacgtcggtgtcctagccgtgacggtagctatgggttctttcttgtccggcaagtcacccctttgagacgggcagccgcagagcagaagaagctaaccggttcgcaccacaggtgccatgatgagcctgtcggcattcgcggtgcccgtcatcctcgacacaaacccggtcgacggcgtgcacacgctgcggcagtgggtgcgcgtctaccactacggacacatttacctgccggccctgtgcgtggccacgacggggctgtacgcctttgaagccctgcggaagcgctctcagggcaaataccagtgggtgcggtacgcactggcggcggtttcgaccctggtcatggtgccctttacctggatcttcatgacgccgaccaataatacgctgttcgcgctcgaggccgccgccgccgcgtcggatccgggagctctggcagacaccccgggcgccgtggtacgctcgctggtcgtccggtgggcatggctgcacgtgacgaggtcgctgacgcctctcttcggggcatatctaggct

SEQ ID NO: 1112 - DNA, 694 bp, Artificial
  Synthetic
ggtgcaaggatcgtgctactgggctctgcaacaaccaaggacaactcgcaagagagaatatggcgaccaagcgtgatgccgccgcaacaccggcagcaccggtacgagggccggccgacgtcggtgtcctagccgtgacggtagctatgggttctttcttgtccggtgccatgatgagcctgtcggcattcgcggtgcccgtcatcctcgacacaaacccggtcgacggcgtgcacacgctgcggcagtgggtgcgcgtctaccactacggacacatttacctgccggccctgtgcgtggccacgacggggctgtacgcctttgaagccctgcggaagcgctctcagggcaaataccagtgggtgcggtacgcactggcggcggtttcgaccctggtcatggtgccctttacctggatcttcatgacgccgaccaataatacgctgttcgcgctcgaggccgccgccgccgcgtcggatccgggagctctggcagacaccccgggcgccgtggtacgctcgctggtcgtccggtgggcatggctgcacgtgacgaggtcgctgacgcctctcttcggggcatatctaggctttacggggcttctgtgcgaaatgcgatcgtcggcctaaacagctagtgcggcggccgggattctcggggtggggaagacgggtgtggcttgcaaggatgttcg

SEQ ID NO: 1113 - DNA, 618 bp, Artificial
  Synthetic
tcccatcccatcttccaaaccacatcatcaatctctaagcgttgcccattatgaagagcgctttgatcgccgccgcggcgcttgttggctccgcccaagctggcgtccacaagatgaagctgcagaaggtctccctcgagcagcagctggagggttcaaccatcgagtcccaggtccagcagctcggccagaagtacatgggcatccgccctactagccgtgccgatgtcatgttcaatgacaaggtgcccaaggtccagggcggtcacccagtgcccgtcaccaacttcatgaacgcccaatacttctccgagattaccatcggtactccccctcagaccttcaaggttgtccttgacactggaagctccaacctttgggttccctcccagtcgtgcaacagcattgcctgcttcctgcattccacgtacgattcgtcctcctcgaagacgtacaagcagaatggatccgacttcgagatccactacggatcaggcagcttgactggcttcatctccaatgatgtcgtcaccattggtgacctcaagatcgagaagcaggactttgccgaggctaccagcgagcccggccttgcctttgctttcggtcgcttcgacg

SEQ ID NO: 1114 - DNA, 579 bp, Artificial
  Synthetic
agctggataaatttctcctgtcatcctcatttcgctgccctgcgccacgacaccggctgctgcagtcccttttctaggcgatacccagcatctgcactctgcccttttttatattctctcctttgaaactcgcattctcgtcgcgatagctattccagcggttgccctaactttctatttgcatcacataacctgacaaaatgggtgaatccagacaagagctcctcaattggctgaacagcctccttcagcttaacatgaccaaggtcgagcagtgcggaactggcgctgcgctctgccaggtctttgacagcatatacatggacgtgcctatgtccaaggtcaagttcaacgtcagcggcgattacgcctacatccaaaacttcaaagttttgcagaacacgttcctcaagcaccaggtcgataagcccatccccgtcgaatcgttggtgaaatgtaagatgcaagacaacctagagttcttgcaatggacgaagaagttctgggacctcaacttccccgaccacgattacgacgctgttgcacgaagaaaggctggcggttgcgcccgcagccagt

SEQ ID NO: 1115 - DNA, 544 bp, Artificial
  Synthetic
agcacggagcaccaccatggcttcaaggttgaagatctggggtgcctgcaggactctggcggtccggacgcagcccgtccgccttgcggctcagccattccgaaaccaggtttcagcgactcgattctatgccgacgatgcgaccaacaaaccctccaattctccgagcggtgcaaagagagaagcttctagatcagtttctaaatcagaaccaacaagttccagggttactgagggcacctctggagaattgacccagaaagccgcacaagagacatcttcatcacaagcctcacccattgaagcgctagacgatgcgaccttggaacaaatactatatggcggtcgacccgtaacaagtcagcgggagggcggcttgacagaggcgcaagaggaggctctatatcgcgagggtgtcattcccccaacagagcaggcggaagctatcgttgctgccgggtcaccagtcaatagtccctgttggctcagaagtgcaaaacgccggccataagtttggtcttcctcagaagccctatccggacgg

SEQ ID NO: 1116 - DNA, 573 bp, Artificial
  Synthetic
gaagcaaccaagaatctgcacctcactcgataataaaaagaaatcggtactcaaggtttataactcattcaaaatgcgttatactgctgtcctcgctgtcctcggcttctccggagtcatggccaacaaaaacttcggacccttcggatttttcggaccctggttcgatggcgacttaactatcgatgacctcgctgactttcagtttcctgagaacccttgtgagttcattggtggtacttgcgagatcgccacttcccttacattctgcgctggtcggggcgacttcagcgttgatttgccttgtggcgttggcctcggctgctgctggcaccaggacaccagcaatgtttggtttgagcaatggaaggagtggctcgagctacacagccgcatcaactaaagccgctttaatgtcttgacgctttgatggcttgacgcttctatggcttgacgcttctatggcttgatgctttaatggcttgacggagtcttcaattggcacggtagtgggtgatggagaaattagccgtactgaactcaatgagagattgttaaccccgattaagtagt

SEQ ID NO: 1117 - DNA, 317 bp, Artificial
  Synthetic
gggagatgtgtgagtgagtctctacatatgcagccgaccttgacagaatcatgttgagtcgccaggcaggtcacagcggtagtgggaattagtgggatagattatagcgggatagcgggccaagcgctgtgggaagtacatgtacaagtacgggtaccaggtgctaggcatgtatttgcggatgctgagtggctggagcggtgctcgatagctgggacggcggggcgcgagatggcccagaagtggctctgcagtactgggagatacatggatgggcatcgggaggtacaagctggagatggatctctccaaacctt

SEQ ID NO: 1118 - DNA, 544 bp, Artificial
  Synthetic
tttggactgtaggctgtagaggagtatggagccgttgtgtgcctctgtctgacattggaggattctggatccattgtgtgcctctatctggcattggaggagtctggagttgctgtgtgcccctgtctggcagtggaggagtgcggtgttgctgtgtgctcttgtctcgtcggcgaagcatcagtgtagcctgagcaggtgccgtaaagaccggtgctacgggcaactgtgggagcttgggaggaaggacaaacggttttgccgcctctggatgcttttccaagaacgcttgttcatattgaccaaccccgaagaactcgtccaagtcgctcagagtaggagagggttgttttcgttgctgagactgagagccattagttggtgaagcagcattatacatttcattcatagagcgagaaggtcttggttccgcgcgctgggctgcgtagcttgtttgtttgcttagcccaggcttggatggagtgataacggctgaaattgaactgcttgagtcggagctacccgatagatttcgcgggattct

SEQ ID NO: 1119 - DNA, 447 bp, Artificial
  Synthetic
tttcgagcgctggagatatcgacacaatggccaagaaagcaaaggcaagattgatcaacgtccggctcatctccatggccatgaccggcttcttctacaccttcaagcggcctagaacatcgcccatgatgggaatgctgaaatacgacccgatagtccgcaaaaaggtcttgttcctagaaacgaaaaagcgatccaaatagagacatttccgagcaatgtaaaatttcaaactatacacctcacggacgggaaaataatgattgggttgcgggcggtctggttgttcgaacctgcggccacctatgtacatgtatcaatacgaagagcatttctggagttttagggatgggctggcattgcgctcgatgcgctgacaggtcacgatatctggtctgattggaatataaattcactcccaaatattccacttttgattcttttctc

SEQ ID NO: 1120 - DNA, 66 bp, Artificial
  Synthetic
aagaaagcaaaggcaagatgatcaacgtccggctcatctccatggccatgaccggcttcttctaca

SEQ ID NO: 1121 - DNA, 609 bp, Artificial
  Synthetic
gccagtacgaacgaacattcagccttgtgcaggggaagcagaagatcatatagagcatttatcaagcgaataacagaccctgagacactgaatcagagaagctttagaagctcttcttctctctgtctccgcgcctcttatcgcaaacagcccctctactgctgctgctgcctttgtcaggcctgtcttttcagtgtcgcatgccccgcctcatctttctaccttgcacaactcagcctttgcgctaatcaacgacatctgcgatctgtgtcggcagcagaagagtccccagattcactggtctctcttttattctccttctttctaaacagatctgtgttgccccccaaagcaagcgagaaatacgtcaagatggctcttccgaaacggcatcatcaaagaaaccgaacgccttatggcggaaccagttccccggaatcagcgccgtgcctcacgaagataacctgcgatactttgacgtcgagaatccacggccctgcatcgtcaccatacgaaggcggcattttcaagcttgagctcttcctcccagatgactatcccatgactccgcccaagattcgattccttactaagattttccacccaaac

SEQ ID NO: 1122 - DNA, 632 bp, Artificial
  Synthetic
gagctcagcgtaaaatttgagagtttcattgtcagcttggcggcccccactgagttcgaccgaaaatgaagttcaacattgcaaatccgacaactggatgccagaagaagctcgagatcgacgatgaccagaaactccgggctttctttgacaaaaggatctcccaggaggttgctggagatgctttgggagacgagttcaagggatatgtttttaagattatgggaggatgtgacaagcaaggtttcccaatgaagcagggagtgttgactccaggccgtgttcgtcttctgctgtacagaggtactccttgtttccggggctatggtaggcgaaatggggagcgcagaaggaagtctgtccgtggatgcattgttagtcctgatctttctgttctgaatttggttattgtgaaaaagggtgagaatgatctgcctggactgacagacaccgagaaaccaaggatgagaggacccaaaagggcttccaagattaggaagctcttcaacctttccaaggaagatgacgtcaggaagtacgtcaatacctaccgtcgaaatttcacaaccaaaactgggaaaaaggctagcaaggctcctaagatccagaggctggtaacaccattgactctc

SEQ ID NO: 1123 - DNA, 724 bp, Artificial
  Synthetic
gcaaaatgaaggtgagtgacggtggatattggtgtgactaaggcgacacgggagaacgacagagacggtattgaggggagaaattaccaagtcccgtttgtcgaattatgttggatcacatttggatcatatctctgacaaatttctaacaccagcttaacatcgcataccccgctcagggcacccagaagtgcattgatattgaggacgagcaccgagtccgaggcttctacgagaagcgaatgggccaggaggttgaggctgacttcctcggtgacgagttcaagggctacgtgctcaagattaccggtggtaacgacaagcagggtttccccatgaagcagggagtcatgcaccccacccgagtccgacttctgctgtccaaggactcttcctgttacagatctcgacgagccggtgagcgaaagcgaaagtccgtccgaggatgcattgtctcttccgacctgtctgttctgtctgtcgttatcgtcaagcagggcgatgccgacattgagggcctgaccaccgagactgttccccgacgactcggccccaagcgagccaacaacatccgaaagctgtttgctctctccaaggaggatgatgtccgacagtacgttatccgacgtgaggtgaccaccaagtccggaaagacctacaccaaggcccccaagatccagcgactcatcactccccgacgactcgcccacaaggcccagctccg

SEQ ID NO: 1124 - DNA, 700 bp, Artificial
  Synthetic
ttcgtcgcggctggccctagagaggcggaagcaagagcaagaggagggatctccgccatgaagctcaacattgcgaatcccaccacgggatgccagaagaagatcgacattgatgacgaccagaagctgaagatgttctttgagaagcgaatctcccaggaggtgcccggagatggtcttggagaggaattcaaaggctatgtctttaagatcatgggtggatgtgacaaggatggctttcccatgaagcagggcgtccttaagaacaaacgtgtgcgcctcctcttgaagagaggtgatacttgcttccgtgggtatggacgacgtgatggtgagcgcaggaggaagtcagttcgtggctgtatcgtcagccatgatctgtctgttctcaaccttgtgatcgtcaagcaaggtgacaagcatctgcctgatctcacggacacggagaagccgcggatgcggggtccgaagagggccagcaagatccggaagctcttcaacctgtccaaggaggacgacgtccgaaagtacgtcaacacgtatcgccggacgttcacctccccctcgggcaagaagcgcagcaaggccccgaagatccagaggctggtgacgcccctgacgctgcagaggaaacgcgaccgcatccgcaccaagaaggcgcgcgtggtcaaggccaagctggaggctgccgagtaccaga

SEQ ID NO: 1125 - DNA, 605 bp, Artificial
  Synthetic
gcagttcgtcatctcacggcgcttctacgagttcaaccgaagatgaagttcaacatcgcaaatcccaccactggatgccagaggaagctcgaaatcgacgatgaccagaagctccgagccttctttgacaaaaggatctcccaggaggttagcggagatgcgttgggcgatgagttcaagggttacgttttcaagattatgggaggatgtgacaagcaaggttttccaatgaagcagggagtgttaactcctggccgagttcgccttttgctctaccgaggtaccccttgcttccgtggttatggtaggcgaaatggagagcgcagaaggaagtctgtccgtggatgcattgtcagtcctgatctttctgttttgaatctggatattgctaagaagggagagaaagatctgcctgggctgaccgatactgaaaaaccaaggatgagaggacccaagagggcttctaagattagaaagctcttcaatctttccaaggaagatgatgtcaggaagtatgtcaacacatatcgcagaaacttcacaaccaaaactgggaaaaaggcgagcaaagctcctaagattcaaaggttagtgacacccttgac

SEQ ID NO: 1126 - DNA, 696 bp, Artificial
  Synthetic
aagccgacttcacgcgagccaggtcaagccaaacttgcaccaccacaacactggcaagatgaagttgaacatctcttaccctgccaatggcagccagaagctcatcgacattgaggatgagcgtaagctcgccgtcttcatggagaagcgcatgggcgctgaggtccccggtgactctgtcggcgacgagttcaagggctacatcttccgcatcaccggtggaaacgacaagcagggtttccccatgaagcagggtgtcatgcaccccagccgtgtccgcctcctgctctccgacggccactcctgctaccgcccccgccgaaccggtgagcgcaagcgaaagtccgtccgcggctgcatcgtcgccatggacctgtccgtcctcgccctctccatcgtcaagcagggtgatgccgacatccccggcctgaccgacgtcgtccagcccaagcgcctcggacccaagcgcgccaccaagatccgcaagttcttcaacctcaccaaggatgacgatgtccgcaagtacgtcatccgacgagaggtccagcccaagggcgagggcaagaagccttacaccaaggctcccaagatccagagactggtcaccccccagcgcctgcagcacaagcgccaccgtctcgctctcaagcgccggcaggccgagaaggtcaaggacgaggccaacgagtacgccca

SEQ ID NO: 1127 - DNA, 399 bp, Artificial
  Synthetic
aaaaccctatcccgcgcgccgccgccgccgccgctcccccgcgcactcgccgctcgccgcccgcgagctcgcgccgcttcgcaaccatgaagttcaacatcgcgaacccgaccaccgggtgccagaacaagctcgagatcgatgacgaccagaagctgcgtgcattttttgacaagaggatctctcaggaggtcagtggcgatgctctgggcgaggaattcaagggctatgtcttcaagatcatggggggttgtgacaagcagggtttccctatgacgcagggagtgctcactgctggacgtgtcctccttcttcttcacaggggcacaccttgcttccgtgggtatggcaggcgtgatggtgagcgcaggaggaagtctgtccgtggttgcctcgtca

SEQ ID NO: 1128 - DNA, 581 bp, Artificial
  Synthetic
acgggatgccagaagaagatcgacattgatgacgaccagaagctgaagatgttctttgagaagcgaatctcgcaggaggaattcaaaggctatgtctttaagatcatgggtggatgtgacaaggatggctttcccatgaagcagggcgtccttaataacaaacgtgtgcgcctcctcttgaagagaggtgatacttgcttccgtgggtatggacgacgtgatggtgagcgcaggaggaagtcagttcgtggctgtatcgtcagccatgatctgtctgttctcaaccttgtgatcgtcaagcaaggtgagaagcatctgcctgattcacggacacggagaagccgcggatgcggggtccgaagagggccagcaagatccggaagctcttcaacctgtccaaggaggacgacgtcctaaagtatgtcaacacgtatcgcccctcgggcaagaagcgcagcaaggcgagtaccagaagctgctgtcgctgcggctccaaggagcagcgggagcacaggagcgagagcttggccaagaggcgagcgtctcgtctctctgtcgcctaatttgcgctatgaacattt

SEQ ID NO: 1129 - DNA, 575 bp, Artificial
  Synthetic
gggcctctccctgacattcattccaccatggcgcgccgccagcatctcacagcgtccatcctgttggtcgtcgtcctgttcttcagcttctcgtatttcctgtccggctcgtccagccacgatgtggaccgaatccatgagcctgcgggagagcccaagtcggaattcaaagtggacctgggtggcatgccagctagtctgcttgacggagagtctatagcccccaagctggagaatgcaacactcaaggccgagctgggtcgtgcaacatggaagtttatgcacacaatggtcgccagattccccgagcagccctcaaaggaagagcgtaagactctcgagacgttcatctacctcttcagccgcctatatccctgcggtgactgtgcgaggcacttccgggggctgctgtcaaaataccctccccagacgagcagtaggaatgcggcggctggatggctgtgctttgtgcataaccaggttaacgagagactgaagaagccgatatttgactgcaacaacattggcgacttttacgactgcggctgcggagatgaagataagaagaaggggga

SEQ ID NO: 1130 - DNA, 343 bp, Artificial
  Synthetic
ccgagttgaagagcttcccgacgacgagaccaagaccaagcccacggtcgaggaacaggattccagcgatgagtccgatgctgaagagctcggcgatggatctctccccgccggttctactgctgtagtccactctcgctacgagaagaaagctcgcaaggccctgctggagaagggcaacttggtccgagtccctggcatcacccgagtcactctccgccgccccaagaacatcctctttgtcatcaacaaccccgaagtctacaagtcccccaacagcaacaccctacattgtctttggtgaggctaagatcgaggacatcaacgccacccgctcagcagg

SEQ ID NO: 1131 - DNA, 696 bp, Artificial
  Synthetic
aaacaaccatgcctcacaaacacaagtcaaaaaagggcgaatttgaagcagagttcgtttgtgagcgtaccatgagtagatttcactgactaatcttggagctagattcgatctcgcccctacagagaaagcgcgatctcttccagtaaacaaacgaaaagcggcatcaagttctggagagcaagtcacaaagaagcgtgccagaagctcattaagaggcaatgacactccgcgagcattcaagagaatcatggctgtggcaggggggaagaaaattagatcaggcttggatgatggtcaactcgacaaaacgactacgaaggctaccgatgtaacgagcgagaaacttcaaattcgtcccggtgaaaatttaggggcctttgccagccgggttgatgcggctctaccagtatcagggcttgcgaagaaaaccagcacgaatgcagagggcaaagacgcattaggattgaaagtgtatcgcactcgcaaagagcgcaaaatgcacaaactctacgatcagtggagggcagaggaatccaagatacgagaaaagagggaggaggagctagagcgcatagcagaacgcgacttggaagacgatgctgccggcattcttacttcagctgccttcgaaaacgacaatagccacacgaaaaagaggaaggggggcaagaggaagagaatagtagaggaaga

SEQ ID NO: 1132 - DNA, 487 bp, Artificial
  Synthetic
gcgctgagaagcctgcatcgcccgccatggccattacgccgacccaattcgccaagaagacggcgcagtcgaccagctggtcggatgcgaagcgtcgagtcctttcttcgtaccgcgaatggatccgagctgcgcctgagatccagaccatgtacaatgtccctctccccatttctaccctccgaacacggatgcgacaagagttcgagcgacaccgatacacgaaccagctgtccatagttgacgtgcttctcttcaagtcccatgcagagtaccaggaaacaatgaacttctggaagcagcagactcacatcttgtcttatttcggcgaaaactttagaggtgacaagaggcttccgtccagcttcatggctggtttccttgagggtcgaaattagaaagacaatgcaagaaagtttgttttgtaaatatctctgtataaagattttgtgccgaaaccctccaataaaaaaaaacacaacaacac

SEQ ID NO: 1133 - DNA, 756 bp, Artificial
  Synthetic
gaatttctacccccctcctaaaaagaccgccccaaagagaaacttcaatggctaccttgaagcaacgaaaggtcgccatcgtgggcagtcgatccgttggtatgcatccgtgaagcccgcgtcttttcttctacccgcgccgtcaaacctttggctgacctgaattccctaggcaaatcatcgctcgccgtgcagttcgtcgatggtcacttcgtcgacagctactaccccacgatcgagaacaccttcagcaagaccatccagtataagggccaggattacgtcactgagatcgtcgataccgcgggacaggtaagattttctcgggctgcttctcttctcgcagtcgcagccgcagccgcagccgcagcccgtcgagacgctgacgctgtgcccaatccgaacaggatgaatacagcattctcaactcgaagcacttcatcggcatccatggctacatgctagtctactccgtgtcgtccctgccctcctttgaaatggtccaggttgtccgcgagaaaatccttaatcatctaggtaccgagtccgttcccatcgtcatagtaggtaacaagagcgacctccgaccagagcagcgccaagtcagccccgaagaaggcaagaagctgtcagaaaagttcgactgcggctggaccgaggccagtgcaaggtacaaccagaacgtcggcagggcgtttgagctcttgattgcccagattgagaaatctcagaaccctggcgagccccctgccaaga

SEQ ID NO: 1134 - DNA, 456 bp, Artificial
  Synthetic
atttatcgagtttcacagggcttacaactcctgtccggggggattggcagatcttgacaactgaggaggaccggatgccgtgacgtgtagctgctaggatgaatcttggattggagatttgccagtcgatttggatggtgcctttcgggatggaggggtggagggtggagagatatgactagtgtggaggtatcacagcgtcggggggctgtggagagttcagggtaagccatttgcggctttcacgctcagtaacactcgggggtttaaaactgactgatggcccatctataccttgcagaacgaatttaggtcctcgcaagactctccctagagccgcgtcccgtcactactgctgctttggcatcaaatagtgctcaatggctaggccgagggatttgaagacgatagcaatgtaacccatacgatctgactgaacgaaaaaaaacaacaacc

SEQ ID NO: 1135 - DNA, 926 bp, Artificial
  Synthetic
atcagtcaaactccaaacgaggtatgtatggccttggtcaccgctgacggcgattcggacctggcaggatgacgccttttatcgtggctggggacagcaatcgaagacgccggccccgatgagcgacaatgaacgcgcgatgatgcatcacatcacatcatgcggttttctgtttggcacacaacggctttggctggcgtttctcgatacgctgcttccccttcggcaatgagcgggctgaaccctcgtcgacggatcgctgagggcactctccacgcttctgggccactcctagtctaacatgtgtttcccttctggcagatacctcatttccaactccgacttgagaatctccttttcatcaataccgccaagatggtccgcacttccgttctccacgatgccctcaacagcatcaacaacgccgagaaggccggcaagcgtcaggtcctgatccgacctagctccaaggtcattgtcaagttcctccaggtcatgcagcgccacggctacattggcgagttcgaggaggtcgatgaccaccgctccggcaagattgtcgtccagctgaacggccgtctcaacaagactggtgtcatctccccccgctacaacgtccgcctggccgacctcgagaagtgggtcgtcaagctgctgcctgcccgtcagttcggctatgtcatcctcaccacctctgctggtatcatggaccacgaggaggcccgacgaaagcacgttgccggcaagatcatcggcttcttctactaaaaaaattggcggagagaggaatgaaaaaaaagtgaatttgtggcattctcggcgttccaatggtggtcgcggtgacggtaatcagcatcctctgatttacagctgggatagtcaccctttagcttagcgtacactggcaataaatcacagatgagaag

SEQ ID NO: 1136 - DNA, 443 bp, Artificial
  Synthetic
gaacctccgttctcgctgacgctctccagtccatcaccaacgccgagaaggccggcaagcgacaggtcctgatccgaccttcctccaaggtcatcatcaagttcctgaccgtcatgcagcagcacggctacattggcgagttcgagtacgtggacgaccaccgatccggcaagattgtggtccagctcaacggccgactcaacaagtgcggagtcatttctccccgattcaacgtcaagatcgacgacgttgagaagtggatccagaacctgctgccctctcgacagtttggttacatcattctgaccacctctgccggaatcatggaccacgaggaggcccgacgacgacacgttgccggcaagatcctcggattcttctactagacgatttggggtttctcaaaagtctggtacaaaaataaaaatgaattgtttgaatgg

SEQ ID NO: 1137 - DNA, 712 bp, Artificial
  Synthetic
gagcgcgggtatgagtaaaagattcaaaatagcccttatcagggcgacgcggtgtttttcgtctccatcttctcaaacacccgcagcacctaaaatgcctccagcacccattctcaagctcaaaaactgcctggtgcgggcttacgatgaaggagacgtgaagtccctcgccagagcagcaaacaatcccaagatatcgcgatggatgcgtaacacattcccacaaccatacacgaccgatgatgccaagaagtggatctctatcgccaactctgcatctccgatccgtgacttcgccatctgccagctggacagttcagtggttatcggcggtattggtctcaaagcacgagacgacatccactaccgaacgatggatatcggctactggctgagtgaagatcgctggcatcaaggtatagccacagaagtcgtcattgccttctccgactgggctttcgaaaacttcaagcagctattaagactagaggccgaagtcttggaggggaacgtaggaagctgccgggttctagagaaagcgggcttcgtgtttgaagcaaggcagaaaaacgcggttgagaaaatgggcgcagtcatggatacctttatatattccaagtttagatagaaaccttagactgaattcttcttggtgaaataatagactttcttttctttttctctttagaaaaaaaaaaacaaaaaaaaccac

SEQ ID NO: 1138 - DNA, 601 bp, Artificial
  Synthetic
  misc_feature (178)..(178): The residue at this position can be any nucleotide.
gacactatacgtcaaaccaacagcctaagaaatgggtcaaggagttcaagaacgccggttgcgacctgtactgcttccactacgaggctgccttttcctctgccgcagagtctcccgaacaaacgaccgataagaagaccaaccccaaggaattgatccgatatatccacgaccaggnactgcttgcaggcattgccattaagcctgacacatccgtcgacgtgctttgggacattctcgagacttcggaatccaaggaaaaacctgatatggttctagtcatgacagtctaccccggctttggaggacagaaattcatggcctcggagctggccaaggtgcaggagctacgaaagcgataccccgaactgaacatcgaggttgacggaggactcggccccagcaccattgaccaggccgccgacgcgggagccaatgtcattgttgcgggcagcgccgtctttggagccaaggacccggccgaagtcatttcgctgctacggaggtccgtcgacaccaagggaggcaagctgtaagtgtggagagttggatatagaagaacaaatagctgcatgaaatagaaatagcgattgcttcccct

SEQ ID NO: 1139 - DNA, 612 bp, Artificial
  Synthetic
gggccaagattgcgccatccatgctttcctcggacttcgccaatctcgcagccgaggcacagcgaatgctggattgtggagcggactggctacacatggacatcatggatgggcattttgttccaaacttgactattggagctccggtggtaagttcgctgcgaaagcatacaagtgcttatttggattgccaccttatggtgacgaatccactcgactacgtagagcctcttgccaaggccggggcgtctggcttcactttccacattgaagcttctcgagataattggacacaaatatcaaagaaggtcaaggaatgcggcatgaaagttggaatttgcctcaagcctggaactccagtcgaagaggtgtaccctctagttgacagtggtgatattgatttagtgttgatcatgactgtcgagccaggatttggaggtcagaagttcatgccggaaacaatgagcaaggtgaaagctcttcgagctcgctatccaaaactagacatcgaggttgatggcggtcttggcccttcgacgatccagcaagccgccgatgctggagcaaactgcatcgtcgctggaagctcggtttttggagctccagatccgg

SEQ ID NO: 1140 - DNA, 642 bp, Artificial
  Synthetic
tgtggtttgaagttctttcctactgcttagttataattgttttcatctatggctgcaacgacagggacccatggtcaaggggagcagataccgccgggaaagcctatgtcaacggagcaacacatgctagataaaggtgctcagatgctgcagtctttgactccaatcaaacaaatgaaccagcatgtttgcacttttgcactttacaaccatgacatgaatcgccaaattgaaactcaccattatgttacccggctcaatcaagattttctccagtgtgctgtttacgactctgatcattccaccgcccgcctaatcgggctggagtatatagtatctgatcgtatctttgaaaccttgcctgaagaagagcaaaaactttggcattctcatgcttatgagataaaatcaggactctgggtgaatcctagagctccagaaatggtggtaaagcgtgaacttgaaaatattgccaagacgtacggcaaattctggtgcacatggcaaacagatagaggtgataagctaccaattggggcaccagcactgatgatgtctccacaggcggtgaatttggggatgattaaggcagaactaatccagaaaagagatgacaagtacaatatgtcgactgatgccatg

SEQ ID NO: 1141 - DNA, 1001 bp, Artificial
  Synthetic
gatatgtatatatagacgagatcagttcccaattgcactagcaaattgagttgaacattccatgtgatcacaactcggcattctattgggcttcgaggcaatacacacaccgaaaatgagttcggaagcacacgacaaagcaccgggtgatcttttccccaaagaggacactgtgctttcgagtgcggcatccttcacacaggactttaagccggttaagaatatatgtgctcatcttaacgctttccacgcttatgcgaatgatcctatgcgatccgtggaagcgaatcattactgcagccaattggacgacgaggttcggcaatgtgtgttatacgactctccggaacccaatgcacggatcataggcatagaatacatgatcacaccgaaacgctacgaatctctacccgctgatgagcgccgcctgtggcattcccacgtatacgaggtgaaatcggggatgctggtgatgcctaaccgcatggtacccaaagcagcatgggaattagcagagaagagggagatggaaaagattatcacgctatatgggaaggcgtatcatttgtggcagacggacagaggggatgagcttccgctgggggagccacagctcatgatgagttatacgagtgatgggcatttggactttgggagggtggaggagcgggatgagaggtttgggacgaattatagggagaagagggaggctaggaaggatattccttctccgaagattcatggagatgctgattcctgctggcatgcttggagggagaggggaaacaagactcctccgagttataaccagaagtgatggcgggcagatgggaaattcgatcttggcgaagatttggaattgttggttgtatctgataacacggacactgcaatatgaaactgtccgacggaattaaagcagagtccgtgattctggtttgtagtttaaacaaacggaaatgacataatggatgaatgacatgcttagtacgttacttatc

SEQ ID NO: 1142 - DNA, 745 bp, Artificial
  Synthetic
ggagaagaggaaaatgaaggcaagagggagagaattgttcttgcaatttgtagctctacaagcagggttccatatgacttcgtgcgacaagcccccggccggacaggttccaagttctgtcgacgatgttcctggaaaggcgacgacgatgatgtccaagatcatggagaaaggtgccgatatgctccagtctctcacgcctgtgaagcaaatcagccagcatatttgtaccttcgcgttctactcgcacgatatgaagcggcagatcgaaactcatcactatgctactcgcgtcaacgaggactttgtccagtgtctcgtcttcgatcgagacgactctcatgctcgactcataggcgtcgagtatatagtgtcggagcgtctcttcgggacgctgccggacgaggaaaagaagctgtggcattctcattcgcatgagataaaagccggactatggactcatcctaccatacccgagatcttggagaagagcgagctccagaagctagcaccaacttacggcaagttctggtgcacttggcagttcgatcgaggtgacaggcttccaatgggtcctccagcgctgatgatgtctccgcagccggagtgcccggttgatccgcagctcgtcgctaccagagacgcaaaatacgacttctctacgagcggaaaggctgatgcgagacgagacatccccgggctttcccgtgtggatcctctggccgatcactggagggcgagaggc

SEQ ID NO: 1143 - DNA, 752 bp, Artificial
  Synthetic
gaggaaaggaagaatggctgctgctgggccgggacctgtggcgacgaaggactatctccctggcagggagaaggagaccaagagcaagatcttggagaccacagcttcggtgctccagggcttcgccccgatcaagaagatccatcaacacctttgcgcgtaagttctctatgcctttgcatgcaagacctcttcgttcttgttgtttcgcttgatccagcttccactgctatggaaacaacttgagccgccaagtcgaagctcaccactactgcggccatgtaaacgaagacctgaggcagtgcgccatctacgacacggatgccgcagatgcgaggctcatcgggatcgagtatctcatctccgagtctctcttccggggcctcccggacgaggagaagaagctctggcactctcacgagtacgaggtgaagagcggcatcctcttctgcccggggctgccggaggttgccgagcatgccgagctttccaaggttgccaagacgtatggcaagacgttccacttctggcagtttgatcgcggtgacgcgctgcctctgggacctcctcagctcatgatgtccttcacgaacgacggtcaggtcaatgaaagcatggcgaaagtcgtcgaggaacggtatggtgtctcgtttgaggccaagaggaagaagcgagctgacatcaaaggaccggatttcggcattgatcctcaggctgactactggcagaagggaaaaggcttcgagactgtt

SEQ ID NO: 1144 - DNA, 717 bp, Artificial
  Synthetic
gaagagagaagaggaaaggaagaatggctgctgctgggccgggacctgtggcgacgaaggactatctccctggcagggagaaggagaccaagagcaagatcttggagaccacagcttcggtgctccaaggcttcgccccgatcaagaagatccatcaacacctttgcgccttccactgctatggaaacaacttgagccgccaagtcgaagctcaccactactgcggccatgtaaacgaagacctgaggcagtgcgccatctacgacaccgatgccgcagatgcgaggctcatcgggatcgagtatctcatctccgagtctctcttccggggcctcccggacgaggagaagaagctctggcactctcacgagtacgaggtgaagagcggcatcctcttctgtccggggctgccggaggttgccgagcatgccgagctttccaaggttgcaaagacgtatggcaagacgttccacttctggcagtttgatcgcggtgacgcgctgcctctgggacctccgcagctcatgatgtccttcacgaacgacggtcaggtcaatgaaagcatggcgaaagtcgtcgaggaacggtatggtgtctcgtttgaggccaagaggaagaagcgagctgacatcaaaggaccggatttcggcattgatcctcaggctgactactggcagaagggaaaaggcttcgagactgttgtcaaggagatggtgt

SEQ ID NO: 1145 - DNA, 563 bp, Artificial
  Synthetic
gaattcaagccaatgtcagtcggtcaacatatgttggacaaaggagcagctatgcttcaatctttgaagcctattaaaatgatgcagcaacatgtatgtacctttgctctttatagtcacgacatgagtcgtcagatcgaaactcatcactttgtcacccgtatcaaccaagacttccttcagtgcgctgtttatgactctgattctacctccgctcgccttatcggagtcgaatacatagtatcagatcggatctttgaaactttaccagctgaggaacagaaactgtggcactctcatgcatatgagattaaatctggcttatggatgaatccaagggttccagagatggtacaatcgagagaacatgaaaatctaacaaaaacatatggtaaattttggtgcacttggcaagtagatagaggtgatgtgctcccgttgggtgcgccatccttgatgatgtctccacaaggagtacccacgggaatggtgaagccagacttggtgcagaaaagagatgagaagtacaacatttcaagtgaagatctgaagaaattgagatt

SEQ ID NO: 1146 - DNA, 489 bp, Artificial
  Synthetic
gacagcctgaaaccgcgagtacaagcatggggttggaagctcgacgtgtgagctctcctttcgtctgccgtcaaaaagtcgatgccaaggagggtattgcagatgtgttgttggccatcagcttaccactggagagatccaagcagtcatcccgtgtgcaggcacaagcccagtaagccgctgctcccaatatggaccacgtcagccatgccgccaaccgagtccctcaccgtcttccaagatggagatgctgtagggctcacccagcggtcgaaacataccgcctgtctgaggccccctccagggcatttgctagccgacctactgtactcgtgtctcgtacacggcagtcgaattggtatacctcctccgaagctggttcgtcatgcgcatgaaaagggtgtagcgagcaagactcagccggccaatcacgaatatctcgggcatccttgtccgtccaggaataggcacaccactcgaaattaagct

SEQ ID NO: 1147 - DNA, 539 bp, Artificial
  Synthetic
tctgcacaaccctgttgggagcgccttgttggactcggtaccccacgcatcacgagcgtttcctccatccacttgtcacccgtgcttgtacgagtatggagtgcctttatcttgaacaacactgaacgcaacataaatgcctctcccggcggctggcacagattccccagcttcggcctgggctgcactcgttgcaaacggctgaatatctttgcactcctccaaacgagcaaggagccggatatctttgcgcaggctccaacagccagcactgaaccgggggcttcgtttccaccgatgaaatgtgcactgtcgaatgctgctcacgattgtcatatgttatccgttcatgtgtgtctacttgcatctcatctgtgcactgtagtgctgtcctcctcgtatcaaacgtccacttgtctggattgcgtaatccgagacggcaagcgaattttcggatgaatggtggtattttgtatcggatggttctggtataggttacctcgctttgaaagcgtataaattcatctcctctctgcatg

SEQ ID NO: 1148 - DNA, 622 bp, Artificial
  Synthetic
agggactgctgctggcggccatccgaagcaatgacccctgcatcttcatggagcccaagatcctgtaccgagccgccgtggaggaggtccccgtggcgccgtatgagttgcctctgtccaaggcggaagtcatcaaggagggcaagaacgtcacaattgtttcatatggtcagccgttgtacaactgcatggcggccatcaagcaggcagaggaggatttgggcatctccgtcgagctgattgacctgcgcacaatctatccctgggacaagaagactgtgtttgaaagcgttcagaagactggaagagtcctggtcgtccatgagtctatggtgaacgctggtgttggtgccgaggtggctgccgccattcaagagaacgcagataccttcaacaggctcgaggctcccgtgtctcgtgttgctggatggagtatccacaacgctctgatattcgaaaagtttcacgtcccagatgttgcaagaatttacgacagtattaaaaagacggttcagtactaagaatgtggggagcgagtaacgtgtgactttatctttgaatttctagagcttcttcctagcataagtgtaaataatagagaataaagctttctgtaacacac

SEQ ID NO: 1149 - DNA, 691 bp, Artificial
  Synthetic
tggtatcaacgcagagtgccattacgccggggactcacaacagaaatagctactaaacaaacagcaaaagataaccagaaaagatggcgactttccctgttgttgatttggggttgcttcaaactgggaaaagggctgaaacattggataaaatcaaagatgcatgtgaaaactggggtttctttgagcttgtgaatcatgggatttcccatgaagtgctggacacagttgagaagcttactaaggagcattacaagaaatgcatggagcaaaggttcaaggaaatggtggcaagtaaaggtcttgaggctgtccaaactgagattgatgatctggattgggaaagcactttttacttgaaacacctccctgtttccactgtgtatgaagttccagacttagaggataaatacagaaatgttatgaaagacttcgcgttgaggctagagaaactagctgaagatcttcttgatttgctgtgtgaaaatctcgggctcgagcaaggttatttgaagaaagcattttatggttcaaagggtccaacttttggtaccaaagttagcaactatcctccttgccccaaaccagaactgatcaaaggcctacgtgctcacactgatgctggtggcctaatcctgcttttccaagatgacaaagtcagtggtcttcagttactgaaagacggtaattg

SEQ ID NO: 1150 - DNA, 440 bp, Artificial
  Synthetic
ctcgagcttgcggccgccaagctcaatggggaagagagagaccaaaccatggctctaatcaatgaagcttgtgagaattggggcttctttgagatagtgaaccatggattaccacatgacttaatggacaagatcgagaagatgacaaaggaccattacaagacatgccaagaacaaaagttcaatgacatgctcaagtccaaaggtttggataatcttgagacagaagtcgaagatgtcgattgggaaagcactttctacgttcgtcacctccctcaatccaatctcaatgacatttcagatgtgtctgatgaatacaggacggccatgaaagactttggtaagagactggagaatcttgctgaggatttgttggatctactgtgtgagaatctagggttagagaaagggtatttgaagaaagtgtttcatggaacaaa

SEQ ID NO: 1151 - DNA, 768 bp, Artificial
  Synthetic
aaaatacatagaaagatggagagtttcccagtggttaacatggagttgcttaacactgaacaaagggctgcaacaatggagaaaattaaggatgcttgtgagaactggggcttctttgaggtggtaaatcatgggatctgtcatgagcttctggacacagtggagaagttgacaaagggacactacaagaagtgtatggaacaaaggtttaaggaaatggttgcaagtaaagggcttgaagctgttgagactgaaataaaggatttggattgggaaagtactttcttcttgaaacaccttcctgtttcaaatatctcagaagttcctgatcttgaagatgaatacaggaaaatcatgaaggagtttgctgaaaagctagagaaattagcagagcaacttttggacttgctctgtgaaaatctaggactggagcaaggttacctgaagaaagccttttatggttcaaatggtcctacttttggcaccaaagttagcaactatccaccatgtcccaagcctgatttgattaaaggccttagggctcacactgatgctggtggaatcatccttctattccaagatgacaaagtcagtggtctccaactactcaaagacgacaaatggatcgacgttccaccaatgcgccactccatcgtcatcaacctcggagaccaactcgaggtgattactaatggaaagtacaagagtgtggagcatagggtgattgctcagcctgatggaaacagaatgtccctagcttcattctat

SEQ ID NO: 1152 - DNA, 681 bp, Artificial
  Synthetic
aaaaagataggatctgtctgctattattatctaagtctgtttaggttttgtgttttttattactacaacaacataatgactattccggtgattgatttctcaaagcttgatggagaggaaagagcccaaactttggttcagatttccaaaggttgtgaagaatggggattttttcagttggtgaatcatgggataccagtggagctgcttgagagggtgaagaaagtgtgtgcagaatgctttaagctggaaagagaagaggctttcaagaattcaacaccagtcaagttgcttaatgagctagcggagagcaagaagagtggcaattataaggttgaaaatgtggattgggaagatgtcttccttctcactgatgacaatcaatggccctccaacactcctcaattcaaggagacaatgaaagaatatagatcagaactgaagaagctagcagagagtgtgatggaagtaatggatgaaaacttaggcttacaaaaagggtcaatcaagaaagccttcaatgaaggagaaggtgacaataatgctttttttggaacaaaagtgagtcactacccaccttgccctcatccagaaatggtgaatggcctaagagctcacactgatgctggaggtgtgattctactcttccaagatgatcaagttgatggccttcaaatcctc

SEQ ID NO: 1153 - DNA, 651 bp, Artificial
  Synthetic
ccccgacttcctcactagattcttaatacacaacccagctggtgaaagagaggaacttgagagttagctagcatggcggcagcattgtcgttcccgatcatcgacatgagtctgctcgacggggcagagaggcccgcggcgatggggctgctccgcgacgcatgcgagagctggggcttctttgagatcctgaaccacggcatctcgacggagctgatggacgaggtggagaagatgaccaaggaccactacaagcgtgtgcgcgagcagaggttcctcgagttcgcgagcaagacgctcaaggaaggctgcgacgacgtgaataaggcggagaagctggactgggagagcaccttcttcgtccgccacctcccggagtccaacatcgccgacatacccgacctcgacgacgactacaggcgcctcatgaagcgcttcgcggcggagctggagacgctggcggagcggctactggacctgctctgcgagaacctcggcctcgagaagggctacctcaccaaggccttccgtggccccgcgggcgcacccaccttcggcaccaaggtcagcagctacccgccgtgcccgcgccccgacctcgtcaagggcctccgcgcccacaccgacgccggcggcatcatcctgctcttc

SEQ ID NO: 1154 - DNA, 676 bp, Artificial
  Synthetic
gtaatattcgctattctattaatttattgtatcacatttttcacacactcaaaaattaaacacatattttaccaagaaagctatggagaacttcccaattatcaacttggaaaagctcaatggttctgagagagctgacaccatggaaatgattaaagatgcttgtgagaactggggcttctttgagttagtgaaccatggtattccacatgaagtaatggatacagtggagaaaatgacaaagggacattacaagaagtacatggaacagagatttaaagaattggtggctagcaaaggtcttgaagctgtgcaagctgaggttactgatcttgattgggaaagcactttcttcttgcgccatcttcctaattctaacatttctgcagtacctgatcttgatgatcaatacagggaagtaatgagagattttgctaaaaggttagaaaatttggcagaggagttactggagttgctatgtgaaaatcttggccttgaaaaaggctacctgaaaaaggtgttttatgggacaaaaggtcccaattttggaactaaggttagcaactatcctccatgcccaaaaccagatttgataaagggactgcgcgcccacacagatgcaggtggtataatccttctcttccaagatgacaaagtaagtggccttcaactcctc

SEQ ID NO: 1155 - DNA, 420 bp, Artificial
  Synthetic
gccattacggccggggttccaaacttggaggataaatggggaaatgtaatgaaggacttctcgttgaatctgcaaaaactaactgacgatcttcttgatatgctgtgtgaaaacctccaactcgagcacggttatctgaagaaagtattctatggcttacagggtccaactttaggtaccaaagttagcaactatcgtccttggcctaagccataactgatcacaggcctacgcgctcacactgatgctggtggcctaatcctgctggttcaagacgacaaagtcagtggtcttcagttactgaacgatggcaaatggattgatgtcccacctatgaaacactcaattgacatcaaccttggcgaccagctcgaggtgataacaaatggaagatacaagagtattgagcacagagttatt

SEQ ID NO: 1156 - DNA, 655 bp, Artificial
  Synthetic
cccacgcgtccgcttcatatcttcttattcatacactaaataaaagcacatttcttcaattcattctgcaagaaagatggagaatttcccaattatcaacttggaaaaattaaatggttctgaaaaagctgccaccatggaaatgattaaggatgcttgtgaaaactggggcttctttgagttggtgaaccatggaatcccacatgaagtaatggacacagttgagaaattaacaaaagggcattacaagaaatgcatggaacagaggtttaaggaattggtggccagtaaaggtcttgaaggtgtacaagctgaggttactgatatggattgggaaagcactttcttcttgcgccatcttcctgtttctaacatctctgaagtccctgatcttgatgatcaatacagggaggttatgagagattttgctaaaagattagagaatttagcagaggagctcttggatttgctctgtgaaaatcttggtctagaaaagggatacttgaaaaaggtattttatggatcaaagggtccaaattttgggactaaagttagcaactatccaccatgcccaaaaccagatttgattaaaggactgcgcgcccatacggacgctggtggcataatccttctcttccaagatgacaaagtaagc

SEQ ID NO: 1157 - DNA, 697 bp, Artificial
  Synthetic
  misc_feature (176)..(176): The residue at this position can be any nucleotide.
cccctcgaccacgcgtccgggagattccggtgatagacttcagtaagcttgactgtgaggagagaagtgcaaccatgacacttctccatcacgcttgtgagaaatggggcttctttatgatagagaaccatggaattgacactaacctgatggacaatgtgaagcagtacgataantagcactatgaagccaatatgaagaaacggttctatgaatcagagctacctatgagcttagagaagaaagaaaaactcagcaacacagactgggaaagcaccttctttctttggcatcgtccaagttctaacatctatgagattgaaggtctctcaaaggatctttgcaacgcagtagatggatacattgatcagctgattaatcttgctgaaaatctttcagaactaatgtgtgagaaccttggcctagagaggagttacattaaggaagcattttcaggaagcaagggtccttctgttggaacaaaagtggcaatatatcctcaatgtacgcgccctgaattagtcaggggattgcgtgagcacacagatgctggtggtatcattctcttactccaagacgaacaagttcctggtctggaattctttaaagatggacattgggtgaaaattccaccttccaagaacaacagaatttttgtaaacactggtgatcaaatcgaaattttaagcaatgggat

SEQ ID NO: 1158 - DNA, 507 bp, Artificial
  Synthetic
gacacacagacgcactcacacactcagcttaagcgagcgagcgagtgaacgagagagagagacagagatggcgagtgttgcctccttcccggtgatcaacatggagaacctggagaccgaggagaggggcgcagcaatggaggtcatccgcgacgcctgcgagaactggggcttcttcgagatgctgaaccatggcatcgcgcacgagctgatggacgaggtggagcgggtgagcaaggcgcactacgccaactgccgggaggagaagttcaaggagttcgcgcggcggatgctggaggccggcgagaagggcgccgacgtgaagggcatcgactgggagagcaccttcttcgtccgccaccgccccgtctccaacctcgccgacctccccgacgtcgacgaccactacaggcaggtgatgaatcaatttgcgtcggagatcgagaagctctcggagagggtgctggacctgctgtgcgagaatctgggcctggagaagggttacct

SEQ ID NO: 1159 - DNA, 507 bp, Artificial
  Synthetic
tgctattcaaacccgtcgcccgacgacctccagattcaaaatgtttgccctttcagaagagtccaaggagcgcattgccaagctcattgacatttctcgagtcgccattcactatggctaccttcctctgattctctacctcggctacacccgcagcgacccccgaccttcagtcatccgccttctctctcctctttcctaaacgcaaacacagacggacatgcgatgttgtacgatatacgattataatacggctcaagggcacgggaaaaggcatgcaacaagaagaggcgaacagtcagagagaagctcaacgtccagcattcatcatggcgtttgggtaatatgcacatgtcttggaagaaggcaggacagggcacgggacgggtgatacaatatgacgacaaggtcgccgagaggacgcagaggaggacaccaaatgctgccatgtaccaataagaatgtattatctactgctccgtactgtaattggaccaagtaaccacg

SEQ ID NO: 1160 - DNA, 172 bp, Artificial
  Synthetic
ggacaggggaagggggtgttagttgcgatagccgatgtttgcatgtgaaggccactactttaccaaaagaggatgctgggatggctgttgccggtcgagtaattaatatgcataatagtatccgcaggtgatgaggtgattttaatgtataattgctaaaaaaaaaacaaaa

SEQ ID NO: 1161 - DNA, 703 bp, Artificial
  Synthetic
tgccggcgctgtaatcttctcttcttcactccgttttctctggcttgcagatacagagtcgctgtaaaagaaaagaggaaagggagaaaggaggagcatgccttcacacagcttcaccacgtccaggtggcttgcgccgcccatccagttcgcgtccttcaagtcgctcctcgttattcccatcatcctctccgtcggcacctttgtcgctctcttcgcccattccgacgtcgacatcgctttactgtggtcgcaatgccactcccgcgcccgcatccccggcctcagccacatcccgctcatcggcacgccgagctgcttcctcgtcagcttcttccagtgcgcgctggactcgctgcggtccaaggccgtcatggccgtgattctgtcgtatgttggcgcgctggcgactgtatgcaccgtggagtcggccaggcgctgcaacaagcctaattcgctgattgcgaagcccacgctgtggtggctgttgttcaacttgctgggaggcgccatggtctggcagttggtgattgtgccggcgtttctgcaccgggccaaggcgctggtgctcgcggagaagcacagccagggaaccggtggtgaagattcgactgtggccgcggctgagctttgaagatattagtgaggagggccgcacgctgccagactccgaggccgtggcgatccccattgccgttgctgc

SEQ ID NO: 1162 - DNA, 609 bp, Artificial
  Synthetic
aaaccaccgtcatcatgcctccagcaagctactcgcgcccgccacaacacgactcgtggttcgcgcctctatccgtcgacctgatcctcaaggttctcaacgtcaccatcttccatcccttcatctgctggctgatcccgctgtgcctgcgcgcccagacgaccaaatgggaggcgccgcccatggtgggcgccattgcctgggccatcttcatctcggccatgtggatcgcgagcgcggtcaaccagcgcattgccaacggcgcgccgcgcgaggtggacctgggcgaggaggtgattgtggtgacgggcggcgcgagcgggctgggcatgctggtggccgaggtgtacggcatgaggggcgccagcgtggccgtgctggatgtgaacgagatggagaatggcgaggcgaggggcgtgacgttttacaagtgcgatgtgagcgacaaggagcaggtggccaaggttgccgttgagattgagaaggatctcggtacgcctactgtgctcattaacaacgctgctattgtcgtgggcaagccgctgctggacctctccatcgatgagatcgagaccagcatcggcaccaacctcctcggccccttctact

SEQ ID NO: 1163 - DNA, 621 bp, Artificial
  Synthetic
gtctatcgttaatacagcaagatgtatgatgtggtatcgaaacaaggacaagaacaaagagaagaagaagtcgtaaagagactgaagtgctgtttgagctggtatcgttgactggttgtatgtagtgtagcaaagttgtgacatatgaagagatgaagcagagaagggttccgttgttgctcaagacgttcggggggtggcagctttgatgagtggccgcccgcccaattacagctacagctaccaagtacgaagtaccagaccttacagcatcgacacgacatgaatgcatgtacctgctggtacagcgacggccctggcgctggttgtcagtgactcgataacgcggggggaggaacagaaggttccaggtccgctggccgggccttgcagtggcagctgttggggggcgtgattccgccaaggggggccgaaggggggtcgcatcccagcctgcgaggtcagagggggagggggcgtgccgcgtacagtgacggcgaggtactgggctggcagaggtgacggaacagtggtcagcggccacaggggcaaacagcgctcgcggcagcgctaatctcagctgggcaaacctgcaggcttgtgctcctatgtacatagcct

SEQ ID NO: 1164 - DNA, 543 bp, Artificial
  Synthetic
ttgaccgaaagccgtctttaaccctccccccagctgcacgaaagcggaggataggcagccggaacggagatctcttcccaaagctggaccaaagggcagggcgcgccaagtacggagcttgtgcactgccgtcccaagtacctggcagcctggcagtacctcggacgcacgctgcctgcccctcaccacgcggagtatccaggtacctcggtgtgcaggtgcaggcagctctccctgtcctgcaggaaaatgcaggatagaggaaagacccggagacaagtctggtgattctggtgattccatcctgccgggggtcaggtttttacataaggcactctcgacttccatcttatttccccactcgatcccgatctctctctctcttgcaccagcagggaaggagtgggcgaccccgaaaaaaaaaacaattagaaaaaaaaaaagaaaaaaagaggcgaacgaaggaacgagcgaacgagcgtcgtcgagaaggcgcgaacaaggagaacggagcctgcggggtaccttggtggacttcctgac

SEQ ID NO: 1165 - DNA, 625 bp, Artificial
  Synthetic
aattgacgaccaccagcgccgccagaatgttcgccgcacgatcaagggcagtctgcgccgcccgccagctgcagcggacaacccgaacctacgcctccgagtcccacggccaccactcgcccgctccggtcaacgagtcctttggggccggatctgttattgccctgggcgctttcctgggcaccgtcctagtctaccagttccgccccacggagagcgacaactggacgccctctgccctgctcaacaagtatcgatcaaaggccgaggactgggaggccgtcaacactctgcacacaaaggccatggagcaggccggctatgacaggaatctgttcgagaacggctccaacaagcaccgatttgtcgacgtcgcataccccgaagctctccaatcccacgccgcgcgaaacatccaggccggccaccttgccaacattgaccatgctgtggaacactaccgacagcagcacctgaagatggaggagaagaaggcggccaagctggcggctgccaaggcagagtagttgcagttgctacagtatatccaatttatagaacaaagtttgcaacacattggggccaattcaatgcgtgataatgattccagttgccggatgtacct

SEQ ID NO: 1166 - DNA, 1040 bp, Artificial
  Synthetic
gaaaactcaaaattaaattaaacataaagacaggctcccaaaaggctgtgacctcttcttattacatctttacaagcctccatagcgtaagattccctccacaagggtcgggctgattttatcctgtcggaataatcacttgcgtaattcgacgtcgtttcgctcgcttcttacggcaagcctacaaatcccattccggcagcgagctcgcctggcgcgtgccaaaatacgacgaccgaaaacaccaagtgcatgtgccaacggtgattggatttgtgcgctccgagatacccaaaccaaaagtacatgttaggatgcacgcgaccacgccatgatcggcgcttgatcacgggcccataatcgagagagaggcgccgctaccggacgatagaacggagggaatagacagatagacgatagacgggacgagcgatcgatcaagtcagagacaacaaataccgagtggcgatgccttcatccgatagtcttgggaggcgggcctcacacggcgctgccagcctggcgacgtcggcatcttctatacacggcgcagcagttgggtttcgagaaggcctgggcttggctggagttgcgaggaggacgttgggaatctgctttctgctattgacggtgtttctatggacgctgtccaactttctcgccagctttatcttttccgatgcaacctacgataagcccttcttcctcgtctacttcaacacctccatgttcgccatctctttaatacccatgtttgtacgatatctgctccagaaaggattccatggcctacgaagcgacgtcaggcgcatgtgggcggagcatcgataccaagccgccccaggcagtcccgcgatagataaagaagatcacctagctcaagaacgcttgctagtagacgaacgagaccccatggcaccaacctcgactccttcaaaagagaagctcagcttccgagaaaccgcagtactgagccttgagttctgcatgttgtggttcctcgcaaactattttgcgtctgcatgtctcgagtataccag

SEQ ID NO: 1167 - DNA, 543 bp, Artificial
  Synthetic
acagaatatcatgtttcaatccaagcaaaacataacgggtgtcaatggagtcgtcaacaatacagtgacgacgggtagagaagctgaaatcattctcaaccattggctggattccatggacaccttcgaaaactggtacggccacaatgaggaatttgtgcataagccgaaagcacttcctcaacagaagcctccagagataaataaagttttcacgattaagaaggaggactggtatctggctattaaagaatacctactagttgcttatacttggtattactagaaagaaaacgaaggaggcgaatgttgttagctgcccttatataaggcttattataagcggcttcctaatgttctaaagccagttaaacagtactttacttatctcagtattatctctggtttacctgcggtatgacttaacctttggggtctggtagttatagtatacttaaatagtgcctgaagctagtttacagaaggtagtgatagaggatatagagtaatattactggctaagaactttattttaactattag

SEQ ID NO: 1168 - DNA, 183 bp, Artificial
  Synthetic
cttgcatctcgccataactttcatctcaaacatagcgggttgcttcctagtctgatagcggcaaaatctcacactcaaggttttactgcgtatccagcatactgcctccgctctctcacaccatctcacaagacaacgtcaaaaagggcatcttttcacagcacagcaataatgagcgctctc

SEQ ID NO: 1169 - DNA, 673 bp, Artificial
  Synthetic
gagagcatctgaggctgtactgcaaaacaccatccgccatatggttatcgaggcaaaccgtcaccagcctgcgcgctatgtaggaagaggaagattaagtgcgatctccagagaccaagatgttcacaatgcagacgagcgaaagaaacgtgtacagggtatcgtgatcttattgatgtgatattccacgatgaaaccaactcgaccaaatccaaagctcttgccaggatctgtcgcgctcaagccgaagcccatgcggataatagtattgcaatcaacaatgccatttctttgtgtttcctgccatacaatattgacgaacaaaccaaatcgtattttgtccatagctatgtccttatccaagaaggcactgctggctatctatccggcgtggctcgactgctagttcgaccaggcctcaacagcgccttggaggcggctatggttgcagttggttcagcggggatggcgtgcaaagaatcatcaccacttctggagctgaaggcaaggcaaagttacggcattgctataaattacatcaatgaagcgatccacaacacggccaagataaaagaggctgggacgctcgccgccattctggcacttgggctttatgaagtcagtgacattctggcagatgaagtgttcgacctcatgttcgtgtacatgctga

SEQ ID NO: 1170 - DNA, 549 bp, Artificial
  Synthetic
cgagcagaagccgccgccgccgcccgaaaccctcgccgccgtcgcttctcctcggggcgcagccatggtggccgcaaagaagacgaataagtccacggacaacatcaacaacaagctgcagctcgtgatgaagagcggcaagtacacgctcggctacaagaccgtcctcaggaccctcaggaactccaaggcgaagctagtgatcatttctaacaactgcccacctcttcggaagtcagaaattgagtactacgctatgttggccaaggtcaccgtccaccatttccacggaaataatgtcgatctggggacagcctgtggtaaatacttccgtgtttgctgcctcagcattattgatcctggtgactcggatatcatcaagaccacgggtgagcagtaaggatgagcggttccgctggcgcttcagatgctgtcacactgagctgttctagacattgtagttgttgctggacttgatttggtctctctcgtgtatcgaacagcttttaccagtcaaccaaagtttcgtgggaacattgttcttggatt

SEQ ID NO: 1171 - DNA, 606 bp, Artificial
  Synthetic
  misc_feature (153)..(153): The residue at this position can be any nucleotide.
ggccacttccctttccccgttgtttcagagtgtttttatcaacaaaaatggcgacaacagggaagaaaacgaagaagacccatgagagcatcaataacaggttagctctggtaatgaagagtggcaagtactctctcggttacaagaccgttnctaatactctcaggagctccaaagggaagttgatattgatatctaacaactgcccaccattgagaaagtcagagattgagtactatgctatgcttgctaaagttggtgttcaccatttcaatggatacaatgttgatcttggaacagcatgtgggaagtatttccgtgtttcatgcctcagcatcattgacccaggtgattcggacatcatcaagtctctacctggtgatcactaagagatattcaccagggttttgctaaaccattttagtgagttgcgaaaatctgtactatctttttattcttgtatttcagagttataccaagattatagaggatgttggtattatctagttttggtggttttatcatttctccagaagttttgaggtcaggtacattatgattttattcacagatcaatttcccttataccattttgcttttcaaaaa

SEQ ID NO: 1172 - DNA, 683 bp, Artificial
  Synthetic
cgttatttattatgcatcttgactacccctcgaccacgcgtccgcccacgcgtccgcccacgcgtccgcgccgtcgacgcatttgcctcttcctataatttccgactacatatctccaggccagagccaaccatggttgctgcaaagaaaaccaagaagactcatgagagtattaataacaggctggctctggtaatgaagagcggcaaatacacattgggatacaagactgttctcaaaactcttagaaactccaaaggcaaactcgtcatcattgccaacaactgccctcctctcaggaagtctgagatagagtactatgctatgttggcaaagattggagtccaccactacaatggaaacaacgtagatttggggactgcatgtggtaagtatttcagagtctgttgcctcagcatcattgatccaggtgattctgatatcattaagagcatgcctggtgaccagtgagatagcagctgatgttagatcgctccaatgaacactgctcaatcatagtggaactttgccgtttttccttattgagacaaatatctagtttagatgagttttgctactttggtgatgttaaaaggaagttttgatggtatttggaatcttaatgacatcaattttttttcctggagttttgaatcttctaattgactgtcatttgttgctta

SEQ ID NO: 1173 - DNA, 642 bp, Artificial
  Synthetic
tgaccctagcaagaagaagaagaagaatattagttccatctctttgccggaagttcaacagagaaggcaatcatggtggccgctaagaagacgaaaaaggcccaagagagcatcaacaataggctagccctagtcatgaagagtggcaagttcactcttggatataagaccacattaaagtctctacgcggtggcaaagggaagcttattattatctccaataactgtccccccttaaggaaatcagaaatcgagtactatgctatgctctctaaaactggagttcatcagtacagtggaaacaatgtggacttaggcacagcctgcgggaagtactatcgggttagctgtcttagcatcacagatcccggtgattcggacattatcagaactgttgaatagagcttagagaggattaaaggcggtaatgcttatcatattagctcatctcgagggggcttctttggaagacttgcatgaatttccctagttttcttttcttgctttattggatcagagaaaccaattaatatatatggctaaattaaacatggaaaattaaatttgtagtagccgactgttttgccgtgtcattggtgttgcaagtaaggttctcgtttttgtgccaaaaaaaaaaaacaa

SEQ ID NO: 1174 - DNA, 470 bp, Artificial
  Synthetic
gaagagagaggagagatccaagatggtggtcgccgggaagaagcagaagaagacccaggagagcatcaacaacaggttggcgctggtgatgaagagcggcaagttcactctgggctacaagacggtgctcaaatcgctgcggagtgggaaaggcaagctcgttctcatctccaacaattgcccgccgctccgcaagtcggagatcgagtactacgcgatgctctccaaaaccaacgtccaccattacagtggaaacaatgtggagcttggtaccgcttgcggcaagtactatcgggtctcttgccttaccatcacagatccaggcgattcggatatcatcaaatccatgtccgccgagtgaaaatccatccatcgatcagcgctcctctgttttgtttcgctgttcaacttcttgtaggcctcttactctagaaatatggaactttaatggaaaaacatttccttcatag

SEQ ID NO: 1175 - DNA, 616 bp, Artificial
  Synthetic
gcaaccgcatcaatctaatcgcaagatcgcagctcgcgcccaaaatcagtcaaaatggcccctcagaagaagagcaagaaggatgccaacagcatcaactccaagttggcgcttgttatgaagtccggaaaggtcactctcggctacaagtctactctcaagtctctgcgatccggcaaggccaagctgatcatcattgctggcaacactcctcccctgagaaagagtgaactcgagtactacagcatgctgtccaaggctcccatccaccacttcgctggtaacaacattgagctcggcactgcctgcggaaagctcttccgctgctccacccttgccatcctggatgctggtgactctgatatcctcagcgaccagcaggcttaaatagccgaaatctagtgcattcaaaacggcgttgggggtaaaacggttcaagggcaatatggataccatacactttcacattatgtgcgagacgaaaacttttgatgcgagacatcatctactaggaaggcaaatcctttggggatggaaaaaagccccagaaatttccaagtgatagttatctcaatggaataatacagccatgaagactgttccccctgtcaaaaaa

SEQ ID NO: 1176 - DNA, 658 bp, Artificial
  Synthetic
taatcgcaagatcgcagctcgcgcccaaaatcagtcaaaatggcccctcagaagaagagcaagaaggatgccaacagcatcaactccaagttggcgcttgttatgaagtccggaaaggtcactctcggctacaagtctactctcaagtctctgcgatccggcaaggccaagctgatcatcattgctggcaacactcctcccctgagaaagagtgaactcgagtactacagcatgctgtccaaggctcccatccaccacttcgctggtaacaacgtaagttttgcaatctcagacgccctggacaagtgaagacctggaaacgggtatatctacttgcgccattacacacttctcgcttctttcagaagctactcttgctacccgagaattgccaattcttgcggaattgcccagagaagaagtctttcagactttggagggttcacattggcttacattattcgtaaaacagattgagctcggcactgcctgcggaaagctcttccgctgctccacccttgccatcctggatgctggtgactctgatatcctcagcgaccagcaggcttaaatagccgaaatctagtgcattcaaaacggcgttgggggtaaaacggttcaagggcaatatggataccatacactttcacattatgtg

SEQ ID NO: 1177 - DNA, 473 bp, Artificial
  Synthetic
cccacgcgtccgcggacgggggggcggacgcttgggttcgacagaagccgagttaagcggcgatagaagcaacaaaggtgaagttgtgccggtctggtggtttattggaaagaaacgaagagaagaatgttccggtcaagggaagcggcctttggtcagtagccaaagggcagatcaagcgccgccttggaggattaaaagggcggctgcaggggtcccaaggctggtgcgcctcatggaattgtatcgaagaaagtcgatggtgtggcggtgcccgataacgcaaaaagctggcaacctttgtgctgccatgcgggctagcagcgggtaccgccgagtatttgtttgtcactgtacagaggcgagacgtgaggccgagattcgcattggttcggagtctggagtagggaggacaatatggtagcacgattgtcattgtgattgctttgtttattagtacttaaaaaaaaaat

SEQ ID NO: 1178 - DNA, 133 bp, Artificial
  Synthetic
ggccaatatgtggcctgcatgctgtttctgatacaaatcctcgtaatgcacagacgtgaatagtgctggcacaagtcacattgctgctgccttgaagggttccatttacattttggtgcagctctaccaaccg

SEQ ID NO: 1179 - DNA, 596 bp, Artificial
  Synthetic
gccgttctcaccacagcctgcgcgctctggcgcggaccgggcgcgccttgggagtgcggatagacagccctttgtcgcaacaaaccgttcggcggaaatcaggtccgtacggctacactcaggccaaggctcttgtcttctccaagaatggagagccatcagatgtactacagttgcacacgttttctatttcgccctcgatttcgtccaaatcccttttgttgcggtctcttgcggctcccattaaccctgcggatataaacaccattcaagggacttatggctctcagcctagcttcacatctttaatagggacgtctagcccgtccgccatcccaggaaatgaaggtgtcttcgaagttgtttcaacgggcgatccggcatcacctattcgcaagggggattgggtcatcccggcagttgcgcaattcggcacatggaggacgcatgccgttgcagagctggatcaggtcttgaagatcgacaaggagggactgcgcgcgactcaggcggcaaccatctctgtcaatcccagcacagcatatcgcattctgagggcatatggccccagcactggactgggaggcattggaatg

SEQ ID NO: 1180 - DNA, 341 bp, Artificial
  Synthetic
gaacaatgcagctggtgacaggtttgtcaagtggcaggggagaatcgtattcgtgtggcgatggtgatgtcgaatttcgaatgagggagccttggcgcgaagaaaaaagaagagagagagagagcggagaggagaggagaggagagtgaaacaaggagaagtacagaggagagaggagagagacgctgtggtgctaagcaaccacgagagaggaacatgaatgcggtttacaaggttgacattggcgaacgagcttggaccgctttgacaatgtgatgtgatgcaggctgggtactccaaatgtttccaattgaacgaatatccaatcagacaagtagaga

SEQ ID NO: 1181 - DNA, 226 bp, Artificial; identical to SEQ ID NO: 389
  Synthetic

SEQ ID NO: 1182 - DNA, 583 bp, Artificial
  Synthetic
gtggatgcggtcgtctcagtttacctgtcccatttctactcatgccattcttgtttaccatctgcattgctctgtcgaaaaccacaactgcctcgtgccaaaagtcatgactcagcagggaacaattcgaaaggcagaacctcagctagaacgccaggctttcctcctatcgggtccatcagcttgattcggcagcctgcaattgaattggccatcatgtggggttccgatgtgcaaaaacccgcaattgggggaccttgtgcgaagctcccgctctgtacaggcacgggtacaggtagaggtacacgttacatgtgtcacggaatacgggggcacaagagacaggcggagaagccgtcccgaacgagtacctggcggcgaacagatgggcagagacaagtgtcggaatagccgaccttgcatcagtccttacagtagcgagcgtttgcacaacgctcttggtattgctcgggaataaaacgtcgaaggaggatgtcatcaacttgttggctcaggcaaggtatgtacgagtaccaaaaggttaagcataaggcactcgcagtgctgctaccggtttgtatgt

SEQ ID NO: 1183 - DNA, 522 bp, Artificial
  Synthetic
atgggattgaatcgtctttgagccatggttgaaaagtgcttggggagaggagatggggatgtggattatagaggggttcatcgtattagcaatttagcctaaatagagcttttgtctctgctactttgaggcgttgctagcaagcggtatcttggctcgggatcgatgtatacagtacttgagccaaagatgatattgctcttggccatccacaaaactccgtacgagtactcatacttgatacttctcatctcaagtaatagatgccatgccatagaggtaagcaagtcaacttgaggaacagggtatatacagattgccatcgttcatctaaattctcttcgtgcacctctttacctttacatgcaccaatttgagcactacctcctcccactacccctggccacgaaccatcaacatcatcagacagccaagataacggcctgactgcggagccggaaccagacccggagcaatgccggagcaagggactacggaatattcgcatgagagatcggagcc

SEQ ID NO: 1184 - DNA, 635 bp, Artificial
  Synthetic
aactaaacatcattcttacactctactctacatcaaaagaccagcatacaaacattcaccatgcttctcaagtctgtcctcctcactctcgccatctctctcgcctcagcgcagagcgaagtcggccggccctgcggcttcaaaattgctccctgccccttcgacatgaaatgcgtcgccgacaacccgtactgccctgatcgcaacaaatgccccggccactgcgagttcaagaacaagtacgcctcgtgcggaggcttcaccccgagaccgcacaactgcgacggcaatcacgtgtgccaggacgaccctcggctgcctccaaactgcggcatggcttgcgatattccgggaatctgcgttccgaagactgctgagttttgtggaggatttgcgggttttgcttgtcctgcgggaaagtattgttatgatgtgctggatgattgtgatcctgagaatggcggtgcggattgcggtggcatttgtttgtagagaaaattatcgatgcttcaggaaatggtaaagtgcaatatcattcgcatctctattctatcatcgtcaagactttagaggtagttatacagtgatagccaagaacgttgctcttgcagatctgaattggcctgcatctccat

SEQ ID NO: 1185 - DNA, 409 bp, Artificial
  Synthetic
  misc_feature (197)..(197): The residue at this position can be any nucleotide.
agccgcgtgtgtttgatggaacccctcatcttgcggcatgggggattgtcctcaagaggccattggttgggacgggcagaagaagaggccattggttggacgataggcagaggaagagattattggttttacgataggcagaggaagaaagacgccaagtactctgtactacctcacaaggtagcagtccctttttntccattccaacgttctgggatcacccagaactgccgaacgcaaccgcgcccttgccctggagatggcgggagaggaagtggtgttggttgtgagcgccgccccaaacgatgccccgtgccgatacggaggggatagattaggtcggtagtcggggtggtacttgatagacgtcaaatatctgaatgaatcagtaatataattgttaagtagg

SEQ ID NO: 1186 - DNA, 512 bp, Artificial
  Synthetic
gtccaattaggcattgacagcaaaccaattccctccataactgggcctcttcacacccgtactcagaatgaccgacagaatattccgcatctttaacccgggagaaccaaagggtgatcccgttgagaagaggcgcgctcagctgcgacgtgcccaacaatcttatcgagatcgcaaggacaagtacaccaaggcgctcgaggctgaactagcacggtctcggaagagcgaggcgggcttgacgttccagatcgagcagcttcgtgtcaaagttcagaaactggccagtctcttgtcccaaaatggcatctcacttcctccagattttgacaatgaggaacaacttcatgatgatgtaccgcgtatagattcatctccgctcacaacgcgtggacaaccacaaaccgctgaaggcttcctatcaagtacagattcaacctctcctgagtcggtgacggaccaaggagctatcttaaatagtggaaaccgcactctacggcagtacagttcga

SEQ ID NO: 1187 - DNA, 583 bp, Artificial
  Synthetic
ccggtgatgcagaccttggtccagtgatcagcaaacaggctaaggaacgtatctgcaaattaatacaaagtggtgctgataatggtgctcgtgtgctgcttgatggaagagatattgtggttcctaacttcgagaatggtaattttgttggtccaacactccttgctgatgttaaaagtgaaatggaatgttacaaggaggagatttttggtccagttcttctcttgatgaaggctgagagcctagatgatgctatccaaattgtgaacagaaacaaatatggcaatggagcatccatatttacaacatctggtgtgtctgcaaggaaatttcaaacagacattgaagctggccaggtgggcatcaacgtgccgattccagtacccctgccgttcttctccttcaccggcagcaaagcctcctttgcaggagacttgaatttctacggcaaggcgggcgtgcagttcttcacccagatcaagacggtcacgcagcagtggaaggagtcgccggctcagcgcgtctccctctccatgcccacctcgcagaagtgaggtgaaaaaaaagaaaggcatcttgtacg

SEQ ID NO: 1188 - DNA, 964 bp, Artificial
  Synthetic
aaccacgccgccgtcctccccgactgcaacaagaaccacttcatcaacagtgtcgtgggagctgcctttggagctgccggtcagcgctgcatggccctgagcacactggtcatggttggcgagaccaaggagtggctctctgaggttgctgagcatgcgcaggcgctcaaggtcgatggtggcttcgaggagggtgccgatctgggccccgtcatctccccccagagcaaggagcgcatcttgagcatcattgacagcgccgagaaggagggtgctacgatcctgctcgacggccgtggcttcaagtctgaaaagtaccccaacggcaacttcatcggacccaccatcatctccaacgtcactcccgacatgacctgctacaagcaggagatcttcggccccgtgctggtgtgcctcaacgtcgagaccatcgacgacgccattgagctcatcaacaagaacgagtacggcaacggcgttgccatcttcacaaagtcgggcgccaccgccgagacgttccgcaagaacatcgaggccggccaggtgggcatcaacgtgcccatccccgtgccgctgcccatgttctccttcaccggcaacaagaagtcgattgccggaggcggtgccaacaccttctacggccgacctggtatcaacttttacacgcagctcaagacggtgacggcgttatggcagagcgccgatgccgtggccaaaaaggccgcggtgcacatgcccacgctgcagtagaagatgaaattgggttgagcggtttaggattgtttgtgtgcggaatatgacggaatggtgggaaaaattgatgatgccttgatgaaatgaagggtggttgtctcacagaacatgcatgtactgtacataatatagccacgagcagatgggctggacagcatgggaattgctttttttaagcagaatgaaataaatctacgttaaatccgaaaaa

SEQ ID NO: 1189 - DNA, 511 bp, Artificial
  Synthetic
gacgagcaagttcgtgagcagattatcaccccgactcattccttattccattgggccgtggaaaaggtacagaacaggcgaatactggtacagataggtggcggcgaggcaattttcttgctacctgatgtatacatgtctccctggggaataaatcccgtgcatgtaggtacaggtaccggtactggcactcttcgaagttcttttgcctctctaacacagcatgacgcttctcacaagtgattctccagctgtctcacatccagcatccatgttctctggagaactacagacagccaaccaactgagaaatcctcaatgcaatcatctgcccatcccaagcaaaaagtctcacaaggcacgtcccgcaacactcaacttgtctctcctctgagtctcttcctcccccacatctgttgggaattttgttgaggggccacataaacccgcccagccccagcgccaaggggtcccctttccctggggccgtcgatctggcgtggggcacccc

SEQ ID NO: 1190 - DNA, 350 bp, Artificial
  Synthetic
cccacgcgtccgagagagagagacgagcaagttcgtgagcagattatcaccccgactcattccttattccattgggccgtggaaaaggtacagaacaggcgaatactggtacagataggtggcggcgaggcaattttcttgctacctgatgtatacatgtctccctggggaataaatcccgtgcatgtaggtacagtgattctccagctgtctcacatccagcatccatgttctctgcagaactacagacagccaaccaactgagaaatcctcaatgcaatcatctgcccatcccaagcaaaaagtctcacaaggcacgtcccgcaacactcaacttgtctctcctctga

SEQ ID NO: 1191 - DNA, 163 bp, Artificial
  Synthetic
tgcgagcaaacagaaagcagcccgtcatccttcgggaacccgcatgatcagcgcctggccgtctgggggtggctgagaggtcgctgggtcgcgggttaatgaaacacgggctctgcgtttatttggtggtgatcgacacttttgccctcgcagcgtgaggact

SEQ ID NO: 1192 - DNA, 581 bp, Artificial
  Synthetic
atcgcatctaccgaactccggagttctcgcaaaaggttcgcacattgtattttcgaaagcgaagatacacatatacacaaacaactacaatatgtcggagaaccctacgacaaacgggcacgacgcccttgaagagaagctcggccgcctggctaggaaacccggcatcaaggccagcctcgttttggaccgagcaaccggcgcaatcctcaagacgagcggccagatcgacgcgctccagacggcgaaatcgcgaaacgcgtcaacggcggcctcattctccaacgacgctcccgcagcggaggagggcgaggcgcagggcgtcgaagagtttgcggaaatgatctggaactttgtcaacagctccgggcagctagtcggggacattgacacagaggacgaattgaaattactgcgactgcgaacgaagaagcaagagattgtcatagtgccggaccagaagtacctactgacggtcatccacgatactcagccgggctgattacacaatttggagcggactttccgatacgcaaagcagcgggtttattaaaggggctactatgatggaatataatact

SEQ ID NO: 1193 - DNA, 576 bp, Artificial
  Synthetic
gggctcgtcaacatcgtccgccataccaagaagaggctgagaataaatctggtgcatgcaaagaatgatagggatatcccctggacggaggataacaagctgtttcgcgctgccgcaagcgagacgattggcactttagatgacgatgaattcgacacttggaaagagtcttgcacagttcgaacgagcaatgattcgtttgtgactacattgaaaacaggcgatgacattatcattcgtcaagagctatttccctatggcggacacaatgaaattctgggctttgcaccggtcagcttggccattatgaggtcgtttgatcttgaaggcaccgcctacgattaatagcgatgccacatagaaggtatagcacgcacatgactgaatattcggtgcgagttgcgagctgtatactcgtacgaaccacgtcgagtctaatggctgaatcattcaaaccaaatctaaacatcaaggaattgagcagttgttttgcaggaatgttctcaagaggacaaaaaaagtctggtctacaacacgacggctacacgccattcattcttgagaggtccaatcaca

SEQ ID NO: 1194 - DNA, 679 bp, Artificial
  Synthetic
ctcacatttctcctactctctctcatatttcatttctctctctagtgtttacacaatggcaccaaaagccgagaagaaacccgccgagaagaagccagcagctgagaaggcaccagtagcagcaggtgcagcggagaagaagccaaaggctgggaagaagcttcccaaggacggtgccggagcagctgcaggagacaagaagaagaagaggttaaagaagtctgttgaaacttacaagatctacatcttcaaggtgttgaaacaggttcatcctgatattggtatctctagtaaggctatggggatcatgaacagttttattaatgacattttcgagaagctggctcaggaatcttctagattggcccgttacaacaagaagcctactatcacttctcgggagattcagactgctgtgaggcttgtgcttcctggtgaattggctaagcatgctgtttctgagggtaccaaggctgttactaaatttactagctcttaatcaattttagagtttgtgttttgattagggtttgtagatgtaaagaattgtccaattagggttgcatttgacatttgtggcatgtaatggacatctatattatgaatgaagagttttctgttttctctgacaaaaaagaaacaagaaagaaaaaaaaaaaccatgtcggccgccttggcc

SEQ ID NO: 1195 - DNA, 1033 bp, Artificial
  Synthetic
caagcttggcatccatgaggactccaccaacaggaccaagattgctgagctcctgaggtatcactccaccaagagtggtgatgagttgaccagcctcaaggactacgtaacccggatgaaggagggccagagtgagatctattacatcactggtgagagcaagaaggctgttgagaactcccccttccttgagaagctgaagaagaagggatatgaggtcctgtacatggttgatgccattgatgagtacgctgttggtcagcttaaggagtttgagggcaagaagctcgtctctgccaccaaggaaggtctgaagcttgatgagagtgaggacgagaagaagcggcaggaggaactcaaggagaagttcgagggtctgtgcaaggtgatcaaggaggtgctcggtgacaaggtggagaaggttgttgtctctgaccgtgtggtggactctccctgctgtctagtcactggggagtatggctggactgctaacatggagaggatcatgaaggcccaggctctgagggactccagcatggccggctacatgtcgagcaagaagaccatggagatcaacccggagaatgccatcatggacgagctccgcaagcgtgccgatgctgacaagaacgacaagtctgtgaaggacctggtgatgctgctcttcgagactgccctcctgacctccggcttcagccttgaggaccccaacaccttcggcaccaggatccaccggatgctcaagctcggcctgagcatcgacgaggacgagtccgccgaggctgacgccgacatgcctccgctggaggacgacgccggcgagagcaagatggaggaggtcgactaaacgtcatggacccatggatgccattctgtcccttctagttatccctctcctagttctcttctcatagctttctgactgctgctgttcgctttctttttggtacgttggatgcatcagttttgtctttgtcttagctcttaaacaatgcgtggtaccttgtcatactgtttgcgttgcaatgctact

SEQ ID NO: 1196 - DNA, 568 bp, Artificial
  Synthetic
aagaactttgaggttctgtacatggttgaccccattgacgagtacgccatggcccagctcaaggagtttgataaccgaaagctggttgatatcaccaaggacttcgagcttgaggagaccgaggaggagaagaagcagcgagaggctgaggacaaggagttcgagccccttgccgccgccctcaaggagattcttggcgaccaggtcgagaaggttgttgtgtcccacaagcttgtcgacgctcctgctgccatccggaccggccagtttggctggtccgctaacatggagcgaatcatgcgagcccaggctctgcgagacacctccatgtctgcctacatggcctccaagaagacctttgagatttctcccaagtctcctatcatcaaggagctcaagaacaaggttgaggccgatggtgctgaggaccgaactgtcaaggacctcaccactcttctgtacgagactgctctgctgacctccggcgtcactcttgatgagcccgccagctttgcttctcgaatcaaccgactcatttctctcggtctcaacattgacgaggctgagc

SEQ ID NO: 1197 - DNA, 521 bp, Artificial
  Synthetic
tcaagctcgaggacacggacgacgagaagaagaagttcgaggagaagaaggcggcgtttgagcctctgtgcaaggtgatcaaggacatcctcggcgagaaggtggagaaggttgtggtgtcggacaggatcgtcgactcgccgtgctgcctggtgaccggcgagtatggatggacggccaacatggaacgtatcatgaaggctcaggctctccgggacagcagcatgtcgagctacatgtcgtcgaagaagacgatggagatcaacccggacaactcgatcatggacgagctgcggaagcgagcggatgcggacaagaacgacaaggcggtgaaggatctggtgctgctgctgtttgagaccgcgctgctcacgtcgggattcagcttggatgatcccaacacgtttggatccaggatccatcgcatgctcaagctggggctcagcatcgacgatgatgttgctactggcggtgaggatgttgaaatgccaccccttgaggaaggggcggatgccgaggga

SEQ ID NO: 1198 - DNA, 671 bp, Artificial
  Synthetic
gaattcgcgaagccttctccaagaacctggggaagaagtgccttgagctcttctttgagattgctgagaacaaagaagattacaacaagttctacgaagccttctccaagaacctgaagcttggaatccatgaggattctaccaacaagtcaaagattgctgatttgctccgataccactcaaccaagagtggtgatgagatgaccagtttgaaagactatgtgaccagaatgaaggagggtcagaatgacatcttctacatcactggtgagagcaagaaagcagttgagaactctcctttccttgagaggttgaagaagaagggttatgaagttctgtacatggttgatgccattgatgaatatgctgttggtcagttgaaggattatgagggaaagaaacttgtgtctgcgaccaaggaaggtttgaaattggaggaaagtgaggatgaaaagaagaaggctgagacattgaaggagaagtttgagggtctttgcaaggtgattaaggaagtgttgggtgacagagttgagaaggttgttgtctctgaacgtgttgttgaatctccctgtgttttggttactggagagtatggttggactgctaatatggagagaatcatgaaggctcaagctttgagggattcaagcatggctgggtacatgtccagt

SEQ ID NO: 1199 - DNA, 341 bp, Artificial
  Synthetic
ggtcgacccacgcgtccgaggaaatctcgctagcgaaaacgtagacgatgtcaaaatcagcaaccgtttggctgacactccatgtgtagtcgtaacatccaagtttggatggagtgctaatatggagaggatcatgcagtcccaaactctctcggatgctaataagcaagcttacatgcgcggaaagagagtcctcgagatcaacccacgacaccctatcatcaaagaactcaaggatagaattgcaagtgacccagaggatgagagtgtgaaggaaacagcacagctcatgtaccagacagctttgatcgagagtggattcatactcaccgacccaaaag

SEQ ID NO: 1200 - DNA, 373 bp, Artificial
  Synthetic
agactgctcctttcttggaaaagttggttcaaaaagacattgaagttctctaccttatcgagccgattgatgaggttgccattcagaatttacagacatacaaagagaaaaaatttgttgatatcagcaaagaagacctggaattgggtgatgaagatgaggacaaggaaaatgagagcaagcaggaatacactcttctatgtgactggataaagcaacagcttggtgacaaagttgccaaggttcagatatcaaaacggcttagctcttcgccatgtgttcttgtatctggcaaatttggttggtcagcaaacatggaaaggcttatgaaggcacaaactcttggtgatacttcaagcttagagttcatgag

SEQ ID NO: 1201 - DNA, 719 bp, Artificial
  Synthetic
ccccgatcaataattatcttccattctcagttcctagtgacactaactgaaaaagtattaagagaagcaaaaatggcagcaacaatgtccactgttgtaggcttagttacttcatctctttcttctccaaagaaggcttgcctcagctcaggcttcttgaaatcaccagtgacagcaagaaaccctttaagggtagcacaagcttcaggaggcaaatttacatgtaattttcaaagagattggctgaggagagacttgaatgtgattggatttggtttgattggatggctggctccttctagcattccagtaatcaatggcaagagtttgagtgggcttttctttgatagcattggcactgaactctctcatttccccactggacctgctctcacttctcagttctggctatggttggtgtgctggcacttgggcttgttcatctgcctaacttttggacaaattggattcaagggacggactgaggactatttctcaaagtaaaatattcccttctgaaaatttgtgtataaataagaaatacgctatttcagttccttaatattggtattttcccttcatttcagcatgttatgagcgtcagaaatcccttctactttaatgtcataataacatatgacattgtgttattaaactgcatcggctgtccgcctgcataacttattttccttttattgctccaagtataacatatgaca

SEQ ID NO: 1202 - DNA, 640 bp, Artificial
  Synthetic
ccccacggagacaacacacgcagctcgccgaccagagacagagagagaccatctgctagcttagctgccatggccgcctccaccgtctccggcctcgccggcgccaccctcgcccgccggccggccttctccaccggcttcacgacgggcgcccgggtgtcggcgaggaacccgctgctgacgaggaacctggagaggaacggcaggatcacctgcatgacgtttccgcaggactggcttaggagggacctgaacgtgatcgggttcgggctgatcgggtggatcgcgccgtcgagcgtcccggcgatcaacggcaacagcctcacggggctcttcttctccagcatcggccaggagctctcccacttcccctcgccgccggcgctcgactcgccgttctggctgtggttggtgacgtggcaccttgggctgttcctggcgctcaccttcggccagatcgggttcaagggcaggaccgagggctacttcgacaagtgaatgaatccatagtggcttttggttagcttgactgtacggacggatgtgtgcgctgcatatccttccttttgtatagggctctgatttgatcctcttgcggatgtacgctgttgtaattctcctcaactccttaaaactttaa

SEQ ID NO: 1203 - DNA, 681 bp, Artificial
  Synthetic
cactaactgaaatactattcagagaagcaaaaatggcagcaacaatgtccactgttgtaggcttagttagttcgtctctttcttctccaaagaaggcttgcctcagctcaggcttcttgaaatcaccagcgacagcaagaaaccctttaagggtagcacaagcttcaggaggcaaatttacatgttttgaaagagattggctgaggagagacttgaatgtgattggatttggtttgattggatggctggctccttctagcattccagtaatcaatggcaagagtttgagtgggcttttctttgatagcattggcactgaactctctcatttccccactggacctgctctcacttctcagttctggctttggttggtgtgctggcacttgggcttgttcatctgcctaacttttggacaaattggattcaagggacggactgaggactatttctcaaagtagaatattcccttctgaaaattgtgtataaaaaacaaatatgctatttcagttctgcatgttatgagcgtgaaataccttctactttaatttgcaagttttttcaaattttgcacttattggtccaactacagcatatgatattgtgttattaaactgcatcgattgtccgcgtgtataacttatattcctttttttttaaaaaaaaattctttgctcttga

SEQ ID NO: 1204 - DNA, 353 bp, Artificial
  Synthetic
gccattacggccgggggatttggtttaattggatggctggcaccttcaagcattccagcaattaatggcaaaagtttaagtggtctcttttttgagagtattggcactgagctctctcatttccctactggccctggtgtcacttctcaattctggctatggatggtctgttggcacctgggcttgttcctctgcctcacttttgggcaaattggattcaaaggaaggactgagaaatatttttaaatggaattttttctgataatttgtgtataatgaagaatcttttaatgtcttaactctcctttctcaatcttcagaatataataggagacaaaccccttctacttttt

SEQ ID NO: 1205 - DNA, 787 bp, Artificial
  Synthetic
acgcgtcgatcgagatcgatcgagggttgcgaaaatcccacatctcccttttcatcgctcgattcaaggttctacctcccatctcacgacccctctctctctcttttcgtttagagagagagctcatattggttagggaaaagggagaaggaagaagagagagaatggcgagtatggtggcatctagtgcattgaggacccctgtggtcggcttgggggattcgaacctccgactcagacggagcaaccccacccctctccgctcatctttcctccgacctgtcgcaagaactgttaacccattgggttcgcatggcaatgctcgggtcacctgctttaaccgagattggctccggaaggatctgtccgtgatcggatttggcctcatcgggtggctagcgccttctagtatcccagccatcaatggcgacagcctttcagggctcttctttagcagcatagggacagagctagcccacttcccaaccgggcccgcccttacgtcccctttctggttatggctggtcacatggcattttggtttatttgttgttctaactttcggacaaatcggattcaagggaaggaaggacgcgtactggtaataataataataaatcctttgcgcgatcattgtcagatgctcggcttagaagctagaaaaagaatctgtaactcaatgtagctttcccttctgttgttggctattgtttgattacactatcctttgatagctgcgagggatgatgtcttcttttatgtaatcctgcacttaaaatttgagttt

SEQ ID NO: 1206 - DNA, 654 bp, Artificial
  Synthetic
gccattacggccggggaagcaccaagtgaatggagatggtggcaatgatagccacagtaagaaacgaaagaagccgcgtagtgctgataaaaagaagcatacccgtgctgaaagaaagaagcggaagaagcaaagacaagagaaagaagcggaagaagcaaagacaagagacagtagtgtgctagcttcgttggaatcaccaagcattgtattagaaaactgtttcctgaagcatcaagtgaatggagatggtggcaatgacagccacagtaagaaacgaaagaagccgcgtagtgctgataaaaagaagcacactggtgctgaaagaaagacgcggaagaagcaaagacaagagaaagaagcggaagaagcaaagacaagagacagtagtgtgctagcttcgttggaaccaccaagcattacaccaagcctttccttgatgattattggtgcaacttgtagttaacattgagtgtcatttgcttattgcatcaaattaggatagaggcctcggcaggatgatgaggagggcctaaatacgaggctgatctccacgtagatctggtgacaccagaaatcccacaaaagtgcgaagggtgtaatcacttatagctcctaattcattttgtcattctacttttccttttcaatctt

SEQ ID NO: 1207 - DNA, 738 bp, Artificial
  Synthetic
aagaaagagaaaagtgggaatgctaaaaactctataaccggtgacaacaagacgacggcaagaagaagaagaagcagcagcagccaagtgacagtgagccatggtctcagcagccacctggatccgatacgttgtcagcaaacttgaatactccgcctctgttggctggaagaactacaaaggaggtcaaattacagatagagaattaggcgataccatatggaagaatttctttcagggtaaattgacatttatgcactttaacaaaggagaggagatggcaccaacactcggagctcagggcggcacacttcttgttcggaagataccttgggttgatccaacgaaagtatttgttggagatgttgtggttctcaaggaccctgtaaagtcagatgattatcttgtccgtagattggctgctgttgaaggctatgagatggtgtccactgatgaaaaagatgagccctttgtccttgaaaaagatcaatgttgggtgctggctgacaatgaaaatgtgaaacctaagcaggaagccaaggatagcagaacctttggccctgtttccttgacggacatagttggcagagctatatattgcctgaggacagcagtggaccatggtcctgttaacaacagtcactttagcgtccagaaggattcaccagtccttgaggttgaactggatgttgatgagatggcacgaagtcacaaagcataggctgtgtgtgctctctg

SEQ ID NO: 1208 - DNA, 621 bp, Artificial
  Synthetic
  misc_feature (148)..(148): The residue at this position can be any nucleotide.
ggggcgggtttaaggcgctggcgatgtggatcaggtatttcctcgtcaagctcgcgcattcggtggccactgctgccaagagctatgacaagggacagatcagtgagaagcagctaggcgatagaatctggaagaatttgttccaagnggcggcttacattcttccaccatgtcaagggagagcaaatggcgcccacattcaagagccagggagagactctactcgtgagatcggtgtatttttatcggtgatgttgtggtctttaaagatccgcaggacactgcagagagtttagtacgtagggtggcggctctggaaggtgacgagcttgtatccaccgatgagaaggacgagcctttctttctcgaggaaggccagtgctgggtggtcgcggataacgagtctttaagtccaaaggaagcgaatgatagtagaagtttcggaccattgcccatgaagaacatctttggacgggcaatctactgcagtcactcggctgtggatcacggtcacgtacttaatagttccgaggctatgcacaaagatactcctgttgttgccgtggagctggatttggaggagctcaagaagcaagcctgaagaaaaatcgagctggtaat

SEQ ID NO: 1209 - DNA, 611 bp, Artificial
  Synthetic
aagcatcggctatggcgggcggggtttaaggcgctggcgatgtggatcaggtatttcctcgtcaagctcgcgcattcggtggccactgctgccaagagctatgacaagggacagatcagtgagaagcagctaggcgatagaatctggaagaatttgttccaagggcggcttacattcttccaccatgtcaagggagagcaaatggcgcccacattcaagagccagggagagactctactcgtgagatcggtacctcttccatctcctaggtgtatttttatcggtgatgttgtggtctttaaagatccgcaggacactgcagagagtttagtacgtagggtggcggctctggaaggtgacgagcttgtatccaccgatgagaaggacgagcctttctttctcgaggaaggccagtgctgggtggtcgcggataacgagtctttaagtccaaaggaagcgaatgatagtagaagtttcggaccattgcccatgaagaacatctttggacgggcaatctactgcagtcactcggctgtggatcacggtcacgtacttaatagttccgaggctatgcacaaagatactcctgttgttgccgtggagctggattt

SEQ ID NO: 1210 - DNA, 630 bp, Artificial
  Synthetic
ccaaaatccaggacaaggaaggaattcccccagatcagcagaggcttatcttcgccggcaagcagcttgaggacggacgtaccctagccgattacaacatccagaaggaatctaccctgcacttggtcctccgtctgcgtggtgggatgcagattttcgtcaaaaccctcactggcaaaacaatcacccttgaggtggaaagttctgacaccatcgacaatgtcaaggctaaaattcaggataaggagggaattccaccagaccagcagaggttgatcttcgccggcaagcagcttgaggacggtcgtacccttgccgattacaacatccagaaggagtctacccttcaccttgtcctccgtctccgtggtggtatgcagatctttgtcaaaacgctcaccggcaaaaccatcacccttgaggtcgagagttccgacaccatcgacaatgtcaaggccaaaattcaggacaaggagggcattcccccagaccagcagaggttgattttcgctggcaagcagctcgaggatggccgtacactagctgattataacatccagaaggaatccacccttcaccttgtcctccgtctccgtggtggtatgcagatcttcgtcaaaacactcaccg

SEQ ID NO: 1211 - DNA, 625 bp, Artificial
  Synthetic
tcgagagttccgacaccatcgacaatgtcaaggccaaaattcaggacaaggagggcattcccccagaccagcagaggttgattttcgctggcaagcagctcgaggatggccgtacactagctgattataacatccagaaggaatccacccttcaccttgtcctccgtctccgtggtggtatgcagatcttcgtcaaaacactcaccggcaagaccatcaccctggaggttgaaagctctgacaccattgacaatgttaaggccaagatccaggacaaagaggggattcccccagatcagcagaggttgatcttcgcaggaaagcagttggaagatggtcgcacccttgcggactacaacattcagaaggagtctactctgcacttggtgctaaggctgaggggaggaatgcagatcttcgtgaagacattgaccgggaagaccatcaccttggaggtggaaagctctgacaccatcgacaatgtcaaagctaagatccaggacaaggagggtatcccaccggaccagcagaggttgatctttgctggtaagcagcttgaggatggaaggaccctggccgactacaatatccagaaagagtcaacccttcaccttgtcctccgtct

SEQ ID NO: 1212 - DNA, 646 bp, Artificial
  Synthetic
cgacaacgtaaaagccaaaatccaggataaggaaggaattccggcagatcagcaaaggcttatcttcgccggcaagcagcttgaggacggccgtactctcgccgattacaacatccagaaggaatctactcttcacttggtcctccgtctccgaggtgggatgcagatcttcgtcaaaaccctcaccggcaaaacaatcacccttgaggtcgaaagttccgacaccattgataatgtcaaggccaaaattcaggataaagagggaattccaccagaccagcagaggttgatcttcgctggcaagcagctcgaggatggtcgtacgctcgccgattacaacatccagaaggagtctacccttcaccttgtcctccgtctccgtggtggtatgcagatcttcgtcaaaaccctcaccggcaagaccatcacccttgaggtcgagagttctgacaccatcgacaatgtcaaggccaaaattcaggataaggagggcattcccccagaccagcagaggttgatttttgctggcaagcagctcgaggatggccgtaccctagctgattacaacatccagaaggaatccactcttcaccttgtcctccgtctccgtggtggtatgcagatcttcgtcaaaaccctcaccggc

SEQ ID NO: 1213 - DNA, 608 bp, Artificial
  Synthetic
agaaagagaaatctttctgtcttaagagtaattagcaatggcttcctcagttctttcctcagcagcagttgccacccgcagcaatgttgctcaagctaacatggttgcacctttcacaggtcttaagtctgctgcctcattccctgtttcaagaaagcaaaaccttgacatcacttccattgccagcaacggcggaagagtgcaatgcatgcaggtgtggccaccaattaacatgaagaagtatgagactctctcataccttcccgatttgagccaggagcaattgctctccgaaattgagtaccttttgaaaaatggatgggttccttgcttggaattcgagactgagaaaggatttgtctaccgtgaacaccacaagtcaccaggatactatgatggcagatactggaccatgtggaagctacctatgttcggatgcactgatgccacccaagtgttggctgaggtgggagaggcgaagaaggaatacccacaggcctgggtccgtatcattggatttgacaacgtgcgtcaagtgcagtgcatcagtttcattgcctccaagcctgacggctactgagtttcatattaggacaacttaccctatt

SEQ ID NO: 1214 - DNA, 579 bp, Artificial
  Synthetic
aaacattctagctttccgtgtagtagctgcattcaagagttgctcatctactttctataatggcagctgctacaatggctctctcttcctcttcatttgccggaaaggcggtaaaactctcaccatcttcctctaaaatcactggaaatggaaaagttaccatgagtaagacggttaccaaggccaagcctgtttctgctggtagcccgtggtatggtcctgaccgtgtcaagtacttgggaccattctctggtgagtctcccagctatttgactggtgagtttcctggtgactatggatgggacactgctggactttcagccgatcctgaaactttcgccaaaaaccgtgagctagaggttatccactgcagatgggcgatgcttggagctcttggttgcgtcttccccgagctcttggcacgtagcggtgtcaaattcggtgaagctgtatggttcaaggctggatcccaaattttcagcgagggtggacttgactacttgggcaacccaagtttggttcacgcacaaagcatcttagccatatgggcttgccaagttgtgttgatgggagctgttg

SEQ ID NO: 1215 - DNA, 85 bp, Artificial
  Synthetic
tccgaatgggtggcctaattggttcttctcaaactgtgttggatggtgagctcagtggctcagcccgtttgagcactgttagcac

SEQ ID NO: 1216 - DNA, 585 bp, Artificial
  Synthetic
gtaagggtcttgatcaagacggttctgatgatcaacaggacatcacccggggtaagggtatggtcgacagtcttttccaggctccaacgggtactggtactcaccatgctgttttgcaatcctacgaatatgtcagccaaggtcttcgtcaatacaacatggacaacactttggacggattctacatcgctcctgctttcatggacaagcttgttgttcacatcaccaagaacttcttgaaattgcccaacatcaaggttccactcatcttgggtgtctggggaggcaaaggtcaaggtaaatctttccagtgtgagcttgtcttcagaaagatgggaatcaaccctattatgatgagtgccggagaattggaaagtggaaatgcaggagagcctgcaaaattgattaggcaaagatacagagaggcagcagaaatcatcaggaaaggaaacatgtgttgcctcttcatcaacgatctcgatgcaggagctggtagaatgggtggaactacccaatacactgtcaacaaccagatggtgaatgccactctcatgaacattgctgataacccgacaaacgtccagc

SEQ ID NO: 1217 - DNA, 684 bp, Artificial
  Synthetic
ggaaaagggagaaagagaaaggtttctgtcttaagagtaattagcaatggcttcctcagttctttcctcagcagcagttgccacccgcagcaatgttgctcaagctaacatggttgcacctttcacaggtcttaagtctgctgcctcattccctgtttcaagaaagcaaaaccttgacatcacttccattgccagcaacggcggaagagtgcaatgcatgcaggtgtggccaccaattaacatgaagaagtatgagactctctcataccttcccgatttgagccaggagcaattgctctccgaaattgagtaccttttgaaaaatggatgggttccttgcttggaattcgagactgagaaaggatttgtctaccgtgaacaccacaagtcaccaggatactatgatggcagatactggaccatgtggaagctacctatgttcggatgcactgatgccacccaagtgttggctgaggtgggagaggcgaagaaggaatacccacaggcctgggtccgtatcattggatttgacaacgtgcgtcaagtgcagtgcatcagtttcattgcctccaagcctgacggctactgagtttcatattaggacaacttaccctattgtctgtctttaggggcagtttgtttgaaatgttacttagcttcttttttttccttcccataaaaact

SEQ ID NO: 1218 - DNA, 615 bp, Artificial
  Synthetic
  misc_feature (490)..(490): The residue at this position can be any nucleotide.
ggaaaagggagaaagagaaatctttctgtcttaagagtaattagcaatggcttcctcagttctttcctcagcagcagttgccacccgcagcaatgttgctcaagctaacatggttgcacctttcacaggtcttaagtctgctgcctcattccctgtttcaagaaagcaaaaccttgacatcacttccattgccagcaacggcggaagagtgcaatgcatgcaggtgtggccaccaattaacatgaagaagtatgagactctctcataccttcccgatttgagccaggagcaattgctctccgaaattgagtaccttttgaaaaatggatgggttccttgcttggaattcgagactgagaaaggatttgtctaccgtgaacaccacaagtcaccaggatactatgatggcagatactggaccatgtggaagctacctatgttcggatgcactgatgccacccaagtgttggctgaggtgggagaggcgaanaaggaatacccacaggcctgggtccgtatcattggatttgacaacgtgcgtcaagtgcagtgcatcagtttcattgcctccaagcctgacggctactgagtttcatattaggacaacttacccta

SEQ ID NO: 1219 - DNA, 551 bp, Artificial
  Synthetic
cccacgcgtccggactacttgggcaacccaagtttggtacgggcacaaagcatcttggccatttgggcttgccaagttgtgttaatgggagccgttgagggttatcgtgttgctggtgggcctcttggtgaggttgttgacccactttaccccggtggtagcttcgacccattgggcctcgctgaagacccagaggcttttgctgagctcaaggtaaaggagatcaaaaatggtagacttgccatgttctccatgtttggattctttgttcaggctatcgtaactggaaagggcccattggagaaccttgccgatcaccttgcagacccagttaataacaacgcttgggcctacgcaacaaactttgtccctggaaagtgagttaacaaaagttgatctttaatctttaagtagtgtgagactgaacatgtagcttgtgagtgatgaacccaaagaagggtcagagtttatttttagcattctgggttatgggttcattaaagggattgtgtaaattggtttggattaattaatgaagaacatgtggatct

SEQ ID NO: 1220 - DNA, 570 bp, Artificial
  Synthetic
attttttctgtatagtagctgcattttcaagagcatttcaggttatttctacaacaatggcagctactacaatggttctttcttcctcttcttttgtgggaaaggcggtgaaactctcaccatcttcctctgagatcaccggaaatggaaaagttaccatgaggaagactgttaccaaggcgaagccagtctcttctggcagcccatggtatggtcctgatcgtgtcaagtacttgggcccattctccggtgagtccccaagttacttgactggtgagttccctggtgattatgggtgggacactgctggactttcagctgatcccgaaacttttgcaaagaatcgtgagctagaggtgatccactgcagatgggccatgcttggagctcttggttgtgtcttccctgagctcttggcccgtaatggtgtcaaattcggtgaggctgtatggttcaaggctggatctcaaattttcagcgagggtggacttgattacttgggcaacccaagtttggtccatgcacaaagtatcttggccatctgggcttgccaagtcgtgttgatgggag

SEQ ID NO: 1221 - DNA, 566 bp, Artificial
  Synthetic
tttttctgtatagtagctgcattttcaagagcatttcacttgatttctacaacaatggcagctactacaatggttctttcttcctcttcttttgtgggaaaggcggtgaaactctcaccatcttcctctgagatcaccggaaatggaaaagttaccatgaggaagactgttaccaaggcgaagccagtctcttctggcagcccatggtatggtcctgatcgtgtcaagtacttgggcccattctccggtgagtccccaagttacttgactggtgagttccctggtgattatgggtgggacactgctggactttcagctgatcccgaaacttttgcaaagaatcgtgagctagaggtgatccactgcagatgggccatgcttggagctcttggttgtgtcttccctgagctcttggcccgtaatggtgtcaaattcggtgaggctgtatggttcaaggctggatctcaaattttcagcgagggtggacttgattacttgggcaacccaagtttggtccatgcacaaagtatcttggccatctgggcttgccaagtcgtgttgatggg

SEQ ID NO: 1222 - DNA, 632 bp, Artificial
  Synthetic
aaaaggaaaagagagaaagagaaatctttctgtcttaagtgtgaattaacaatggcttcctcagttctttcctcagcagcagttgccacccgcagcaatgttgctcaagctaacatggttgcacctttcactggtcttaagtcagctgcctcgttccctgtttcaaggaagcaaaaccttgacatcacttccattgccagcaacggcggaagagtgcaatgcatgcaggtgtggccaccaattaacaagaagaagtacgagactctctcataccttcctgatttgagcgtggagcaattgcttagcgaaattgagtacctcttgaaaaatggatgggttccttgcttggaattcgagactgagcacggatttgtctaccgtgaacaccacaagtcaccaggatactatgacggcagatactggaccatgtggaagttgcctatgttcggatgcactgatgccacccaagtgttggccgaggtggaagaggcgaagaaggcatacccacaagcctggatccgtattattggattcgacaacgtgcgtcaagtgcagtgcatcagtttcattgcctacaagccagaaggctactaagtttaatattaggacaacttaccctattgtccgacttt

SEQ ID NO: 1223 - DNA, 523 bp, Artificial
  Synthetic
cggacgcgtgggcggacgcgtgggcggacgcgtgggcggacgcgtgggcggacgcgtggggtcgagttccagccatctccgaaaatgactttcaagagaaggaacggaggtcgcaacaagcatggacgtggccacgtcaaattcgtccgttgctccaactgcggcaaatgctgccctaaggacaaagccatcaagaggtttcttgtgagaaatattgttgagcaagcagctgttagggatgtgcaggaagcttgtgcttttgaaacgtacactctgcctaagctgtatctgaagatgcaatattgtgtatcatgtgccatccactcaaaggtggatagggtccgctctcgaactgataggagggtccgtgagcctccacagcgattcatgcgcccaagggatgatgctccaaagcctggtcaagctccacgggttcctggagctgctccgacagcagcagctcgtacttgagtgcctgctgttttgatcatgttgtttagctatagtgtgaaagtgactatgg

SEQ ID NO: 1224 - DNA, 544 bp, Artificial
  Synthetic
aaaaatggcagcaacaatgtccactgttgtaggcttagttagttcgtctctttcttctccaaagaaggcttgcctcagctcaggcttcttgaaatcaccagcgacagcaagaaaccctttaagggtagcacaagcttcaggaggcaaatttacatgttttgaaagagattggctgaggagagacttgaatgtgattggatttggtttgattggatggctggctccttctagcattccagtaatcaatggcaagagtttgagtgggcttttctttgatagcattggcactgaactctctcatttccccactggacctgctctcacttctcagttctggctttggttggtgtgctggcacttgggcttgttcatctgcctaacttttggacaaattggattcaagggacggactgaggactatttctcaaagtagaatattcccttctgaaaattgtgtataaaaaacaaatatgctatttcagttctgcatgttatgagcgtgaaataccttctactttaatttgcaagttttttcaaattttgc

SEQ ID NO: 1225 - DNA, 614 bp, Artificial
  Synthetic
gaaaagagagaaagagaaatctttctgtcttaagtgtaattagcaatggcttcctcagttctttcctcagcagcagttgccacccgcagcaatgttgctcaagctaacatggttgcacctttcactggtcttaagtcagctgcctcgttccctgtttcaaggaagcaaaaccttgacatcacttccattgccagcaacggcggaagagtgcaatgcatgcaggtgtggccaccaattaacaagaagaagtacgagactctctcataccttcctgatctgagcgtggagcaattgcttagcgaaattgagtacctcttgaaaaatggatgggttccttgcttggaattcgagactgagcgcggatttgtctaccgtgaacaccacaagtcaccgggatactatgacggcagatactggaccatgtggaagttgcctatgttcggatgcactgatgccacccaagtgttggccgaggtggaagaggcgaagaaggcatacccacaggcctggatccgtattattggattcgacaacgtgcgtcaagtgcagtgcatcagtttcattgcctacaagccagaaggctactaagtttcatattaggacaacttacccta

SEQ ID NO: 1226 - DNA, 657 bp, Artificial
  Synthetic
tccgaaaatatggctctgagaatgtgggcttcttcaacagccaatgcggtaagaatctctagaaccaatctaattgccccctctttttctctttccagatgcttttcaactgttcttgatggactgaagtatgcatcttcacatgaatgggtgaaacatgacggttcagttgccactgttggcatcactgatcatgctcaggaccatcttggagaagtagtgtttgtggatctgccagaaacaggtggttctgtttcccaaggaagcagctttggagctgttgagagtgtcaaagccaccagtgacattaactgtcctatctcgggtgagattgttgaggtcaacacaaagcttactgaaacgcctggcttggtaaattcaagcccatatgaagatggatggatgattaaagtgaagccaagcagtccatcagaattggagtctttgatgggttccaaagagtacacaaaattctgtgaagaagaggatagtcattgacacctgaatgtacttcttggtccaatttggattaactggggtgcttaaggttgctattgttatagaaatttccagtcaataaataaaattgttcaagcataaaaaattatcttccacttgtctcataacatctttgcctatgcagttctgtgatttgat

SEQ ID NO: 1227 - DNA, 643 bp, Artificial
  Synthetic
cccacgcgtccgcaactttctctctgtatacgtcctaatctggggcgacccttttcactccggtcagtttcccgccgggaaatctttaattcttgttgtattgacagcttccttgcttgtaccttcatctcgctttaccgatcttgcactttacagtaatcatcatgaatccagaatacgactatcttttcaagcttttgcttattggagattctggtgttggcaaatcatgtctcctcttgagatttgctgatgattcatatcttgagagttacattagtaccattggtgtggactttaaaatccgcacagtcgagcaggatgggaaaaccattaaacttcaaatttgggatactgctggtcaagaacgttttaggacaattaccagcagctactatcgcggtgctcacggcattattgttgtctatgatgtaactgatcaagagagcttcaataatgtcaagcaatggttgagtgaaattgatcgatatgcaagtgataatgtgaacaagcttcttgtcggaaacaagtgcgatctcacagcgcagaaggtagtttccacagagacagctcaggcttttgctgatgagatcggcattcctttcatggaaactagtgcgaaaaatgccaccaatgtggaaca

SEQ ID NO: 1228 - DNA, 628 bp, Artificial
  Synthetic
aaatttcagaaggttcacctaaatggctcatgctatggcttcaatgggtggcctaattggttcttctcaaactgtgttggatggtcagctctgtggttcagcccgtttgagcactgttagcaccagcagaattgccttggctagaccaggtctcagcattagagcccaacaggggtctgctgacactgaaactagccgtagagccgtcatcggtcttgttgctgctggccttgctggttcctttgctcaagcagcctttgctgcagctaaatcaatcaagattggtggcgctcctcctccctccggtggattacctggaactttgaactcggatgaggcaagggactttggtctaccacttaagaagaggttttaccttcaaccattgactccagctgaagcagcccagagagttaaggattcagccaaggagattgttagcgtcaagaatttcatcgacaagaaggcctggccatatgtccagaatgaccttcgtctcagagcagaataccttcgctatgaccttaaaaccgtaatctcagctaagccaaaagaagagaagggaaagctccaggacctgactggaaagctcttcaagaccattagtgatctggaccatgcagcaaag

SEQ ID NO: 1229 - DNA, 441 bp, Artificial
  Synthetic
tgaaacatgacggttcagttgccactgttggcatcactgatcatgctcaggaccatcttggagaagtagtgtttgtggatctgccagaaacaggtggttctgtttcccaaggaagcagctttggagctgttgagagtgtcaaagccaccagtgacattaactgtcctatctcgggtgagattgttgaggtcaacacaaagcttactgaaacgcctggcttggtaaattcaagcccatatgaagatggatggatgattaaagtgaagccaagcagtccatcagaattggagtctttgatgggttccaaagagtacacaaaattctgtgaagaagaggatagtcattgacacctgaatgtacttcttggtccaatttggattaactggggtgcttaaggttgctattgttatagaaatttccagtcaataaataaaattgttc

SEQ ID NO: 1230 - DNA, 616 bp, Artificial
  Synthetic
ttcaaaccatcaaacaatcacttttctttttcatacaccatggctgcttcttcaatggctctttcttccccttcttttgctggacaggcagtgaaactctccccatctgcctcagaaatcactggaaatggaagggtctccatgagaaagactgtcaccaaacctgttgcatctagcagcccatggtacggcccagaccgtgttaagtacttgggcccattctccggtgaggccccaagctacttgaccggtgaattcccaggtgattacggatgggatactgctggactttcagcagatccagaaacctttgccaagaaccgtgaactcgaagtgatccactgcaggtgggctatgcttggtgctcttggatgtgtcttccctgagctcttggctcgtaacggtgtcaagtttggcgaagctgtctggttcaaggctggatcccaaatctttagcgagggtggacttgactacttgggcaacccaagcttggtccatgcacaaagcatcttggccatctgggcttgccaagttatcttgatgggagccgttgagggttaccgcgttgctggtgggcctcttggtgaagttgtcgacccactctaccctggtggca

SEQ ID NO: 1231 - DNA, 546 bp, Artificial
  Synthetic
cgaatccaccacacggtaccctcctctctcctcctccgaccaccatggccatggccacgcaagcctccgccgccaagtgccacctcctcgccgcctgggcaccggcgaagccgcgctcatccaccctctccatgcccacctcgagggcacccacctccctcagagcggcggcggaggatcagcccgccgcggcggcgacggaggagaagaagccagcccccgcggggttcgtgccgccgcagctggaccccaacacgccgtccccgatcttcggcgggagcacggggggactcctccggaaggcgcaggtggaggagttctacgtcatcacatggacgtcgcccaaggagcaggtgttcgagatgcccacgggcggcgccgccatcatgcgcgagggccccaacctgctgaagctggccaggaaggagcagtgcctggccctgggcaccaggctccgctccaagtacaagatcaactaccagttctaccgcgtcttccccaatggcgaggtgcagtacctccaccccaaggacggcgtctacccgg

SEQ ID NO: 1232 - DNA, 569 bp, Artificial
  Synthetic
cacttacgtagccctgtgtgcgacggcgcaagtgcttgtacgctttcagctagcgtagccatggcttccagggcattcctcctcctggctctaaatctggtcctcttcttcaccgtggccagcgcctgcggcaagtactgcccgacgccttcgacgccgtcgacgacgccatcgacgccgtcctacaacaccaagtgccccaagaacgcgctcaagttcgcggcgtgcgccgacgtgctgggcctcgtcagcgccgaggtcggccagccgccgtacgagccgtgctgcggcgtcctcggcggcctcgccgaccttgaggccgccgtctgtctctgcaccgccatcaaggccaacgtgctcggcatcaccctcgacatccccgtcaagctcagcctcctcgtcaactactgcggcaagaacgtccctagtggcttcatctgtgcttaagctacgtaacgcgcgtacggtgtaacgacgtgctagctttgcatgcatgcagcacgcatgcacgaacacatcgttcgttcttgagtgcctgcatgcatatcggtcgagtctttacttactct

SEQ ID NO: 1233 - DNA, 561 bp, Artificial; identical to SEQ ID NO: 1084
  Synthetic

SEQ ID NO: 1234 - DNA, 609 bp, Artificial
  Synthetic
ggagaaagagaaatctttctgtcttaagagtaattagcaagggcttcctcagttctttcctcagcagcagttgccacccgcagcaatgttgctcaagctaacatggttgcacctttcacaggtcttaagtctgctgcctcattccctgtttcaagaaagcaaaaccttgacatcacttccattgccagcaacggcggaagagtgcaatgcatgcaggtgtggccaccaattaacatgaagaagtatgagactctctcataccttcccgatttgagccaggagcaattgctctccgaaattgagtaccttttgaaaaatggatgggttccttgcttggaattcgagactgagaaaggatttgtctaccgtgaacaccacaagtcaccaggatactatgatggcagatactggaccatgtggaagctacctatgttcggatgcactgatgccacccaagtgttggctgaggtgggagaggcgaaaaaggaatacccacaggcctgggtccgtatcattggatttgacaacgtgcgtcaagtgcagtgcatcagtttcattgcctccaagcctgacggctactgagtttcatattaggacaacttaccctat

SEQ ID NO: 1235 - DNA, 670 bp, Artificial
  Synthetic
caaaatggctcatgctatggcttcaatgggtggcctaattgggggttctcaaactgtgttggatggtcagctcagtggctcagcccgtttgagcactgttagcaccagcagaattgccttggctagaccaggactcagcattagagcccaacaggggtctgctgacactgaaactagccgtagagccgtcatcggtcttgttgctgctggccttgctggttcctttgctcaagcagcctttgctgcagctaaatcaatcaagattgggggcgctcctcctccctctggtggattacctggaactttgaactcggatgaggcaagggactttggtctaccattgaagaagaggttttaccttcaaccattgactccagctgaagcagcccagagagttaaggattcagccaaggagattgttagcgtcaagaatttcatcgacaagaaggcctggccatatgtccagaatgaccttcgtctcagagcagaataccttcgctatgaccttaaaaccgtcatctctgctaagccaaaagaagaaaagggaaaactccaggacctgactggaaagctcttcaagaccattagtgatctggaccatgcagcaaagaccaagaacagccctgaagcagagaagtactatgctgaaactgtatctaccttaaatgat

SEQ ID NO: 1236 - DNA, 508 bp, Artificial
  Synthetic
catcttattgtcacttccatcgcattctcctaattgtcatcactagcttctagctagcttaattaattaattagccatggcggaggagaagcaccaccaccacctgttccaccacaagaaggacgacgagccggccaccggagtagactcctacggcgagggcgtctacacgtcggagacggtgaccaccgaggtggtcgccggcggccaggacgagtacgagaggtacaagaaggaggagaagcagcacaagcacaagcagcacctcggcgaggccggcgccctcgccgccggcgccttcgccctgtatgagaagcacgaggcgaagaaggacccggagaacgcgcacaggcacaagatcacggaggagatcgcggccacggcggcggtcggcgccggcggctacgccttccacgagcaccacgagaagaagaaggaccacaagagcgccgaggagtccaccggcgagaagaagcaccacctcttcggctgatcgacctcatcacaa

SEQ ID NO: 1237 - DNA, 649 bp, Artificial
  Synthetic
gccattacggccgggggcctgaaacaaatttcagaaagttcaccaaaatggctcatgctatggcttcaatgggtggcctaattggttcttctcaaactgtgttggatggtcagctcagtggctcagcccgtttgagcactgttagcaccaacagaattgccttggctagaccaggactcagcattagagcccaacaggggtctgctgacactgaaactagccgtacagccgtcatcggtcttgttgctgctggccttgctggttcctttgctcaagcagcctttgctgcagctaaatcaatcaagattgggggcgctcctcctccctctggtggattacctggaactttgaactcggatgaggcaagggactttggtctaccattgaagaagaggttttaccttcaaccattgactccagctgaagcagcccaaagagttaaggattcagccaaggagattgttaccgtcaagaatttcatcgacaagaaggcctggccatatgtccagaatgaccttcgtctcggagcagaataccttcgctatgaccttaaaaccgtcatctctgctaagccaaaagaagaaaagggaaaactccaggacctgactggaaagctcttcaagaccattagtgatctggaccatgcagc

SEQ ID NO: 1238 - DNA, 685 bp, Artificial
  Synthetic
gccattacggccggggagggctgttaaggtggctttcacatgagcggagcagcaggtaagcttagttactgcagaaagtggcggagctgtgacgctgctgattcaaatctaaagaccaccaaatggctagaggtttgaagaaacatttgaagaggctcaatgccccaaagcattggacgcttgacaagcttggaggagctttcgctcccaagccttcgtctggtccgcacaaatcaagggagtgtttgccgttgatcattatcatgagaaacagactgaagtatgccctgacatacggcgaggtcatttcaattttaatacaacgacttgttatggttgatggaaaagttaggacagataagacttaccccgccggctttatggatgttgtttcaattcctaagacaaatgagaacttccgcctcatgtatgacacaaagggccgatttcgtcttcactctgttagggatgaggaagcgaagtttaagctgtgcaaggtccgatccgtgcagtttggacagaagggtattccatacctcaacacttatgatggaagaacaatccgctaccccgatcctctcatcaaggccaatgataccatcaagctggactagagaacaataagattgttgacttcatcaagtttgatgtcggaaatgttgtcatggtgactggtggtagaaac

SEQ ID NO: 1239 - DNA, 469 bp, Artificial; identical to SEQ ID NO: 26
  Synthetic

SEQ ID NO: 1240 - DNA, 520 bp, Artificial
  Synthetic
ccccccggccagcccacactctgaattctgaaaatagttttgttagtttggagtgaaaagccatggcatctttggcaacctttgctgcagtgcagcccactaccaatgtcaagggcctagctggaagctccattactggaactaagcttcatctcaaatcatctcgcctcaatttgaagaccactaaatccagggccggccctgtggttgccaaatatggtgacaagagtgtatactttgatttggaggatttgggcaacaccactggccagtgggacctgtatggatcagatgcaccttcaccatacaactctcttcagagcaagttctttgagacatttgctgctccattcaccaagagaggtcttttgctcaaattcttgatattgggaggtggctccacccttgcttacttcagttcgacagcatcaggggatatcctaccaatcaagaaaggtccacaacttccacccaagctcggcccacgcggcaagatctaattgctttcggtccaaaattc

SEQ ID NO: 1241 - DNA, 605 bp, Artificial
  Synthetic
ccagttttgttagtttgaagtgaagagcagggcatcttgggcaactcttgctgcagtacagcccacaactgccgtcaatgggctagctggaagctccattattggaactaagctacatgttaaatcatctcgccttaatttgaagtctactaaatccagggctggttctgtggtagcaaagtatggtgacaagagtgtatactttgatttagaggacctgggaaacaccactggccaatgggacttgtatggttcagatgcaccttcaccatacaactcccttcagagcaagtttttcgagacttttgctgctcctttcactaagagaggtctgttgctcaaattcctgatattgggaggtggctcaactcttgcatacttcagttcaactgcatcaggggatatactaccaatcaagaaaggacctcaacttccacccaagcttgggccacgcggaaagatctaattccttttcaatccaactttctcaaccttcattttgtaattgatgtatctgtccccagcttgtaagtattcttgaagcctacctgagacctttgttacagaagttaaatcttattgcaaagttggagcattgctttcta

SEQ ID NO: 1242 - DNA, 630 bp, Artificial
  Synthetic
tttttttttttggggggaaattatacagtaatccacatgtttaatggtacctttggaacaggaaaatacaaattaagttcaaacaataatttcattacataaccacacaacctactgcagctcgaggaaatcaactaccccttgaatattccatggctatggcaactcaagcagctctttttaccccaactctttccacctcaaaatcaagcaatttaccatggaaacaatcctcaactgtgtcattcgccagccctaaaccattcaactttgctgcaccacaacgttccattaaggcctcagctgctgaaggaaagacagaagctccagcgaaagaagccccagcaggtttcaccccaccagagttggacccaaacacaccatctccaatcttcggaggtagtactggtggattgttgcgtaaagctcaagtagaggagttttacgtgatcacttgggattctcctaaagaacaagtatttgaaatgccaactggaggtgcacctatcatgagacaaggacctaacttgcttaagttggcttcatgtaccttaggaggagcttcaactataaagctctcaaacttcaatacggacttcacaaggaccaaagcatgtagtttacatacac

SEQ ID NO: 1243 - DNA, 744 bp, Artificial
  Synthetic
gaattcagttaacagagcacctttgagcttgccgagctctggccaaagctctgccttcttgggcagcagcttgaagaaggtcaattcttctgttgcaccaaaaccatcatcaagaagcttcaaagttgttgctgcacaagaggttgatcctaaaaagaatgaggacaaatgggccggtctttactacgaccagtctgatgatcaacaagacatcaccagaggaaagggaatggttgactcccttttccaagctcctatggataccggaactcacaatgctatcatgagttcttatgaatacgccagcaagggacaaagaacatacgactttgacaacaccatgagtggattctacattgctccagctttcatggacaagcttgttgttcacattaccaagaacttcatgacccttcccaacatcaaggttcctcttattttgggagtctggggaggaaagggacaaggaaaatcattccagtgtgagcttgtcatggccaagatgggaatcaacccaatcatgatgagtgccggagagcttgagagtggaaacgcaggagagcccgcaaagttgatcaggcaacgttaccgtgaagcagctgacattatcaagaagggaaaaatgtgttgtttattcatcaacgatcttgatgcaggagctggacgtatgggtggaaccactcaatacacagttaacaaccagatggttaacgccaccctcatgaacattgctgataacccaac

SEQ ID NO: 1244 - DNA, 618 bp, Artificial; identical to SEQ ID NO: 28
  Synthetic

SEQ ID NO: 1245 - DNA, 626 bp, Artificial; identical to SEQ ID NO: 476
  Synthetic

SEQ ID NO: 1246 - DNA, 679 bp, Artificial; identical to SEQ ID NO: 516
  Synthetic

SEQ ID NO: 1247 - DNA, 628 bp, Artificial
  Synthetic
gaattcaagaggttgatccaaaaaagaatgaggacagaggggccggtctttactactaccagtctgatgatcaacaagacatcaccagaggaaagggaatggttgactcccttttccaagctcctatggataccggaactcacaatgctatcatgagttcttatgaatacgccagcaaggggcaaagaacatacgactttgacaacaccatgagtggattctacattgctccagctttcatggacaagcttgttgttcacattaccaataacttcatgaccttgcccaacatcaaggttcctctaattttgggagtctggggaggaaagggacaaggaaaatcattccagtgtgagcttgtcatggccaaaatgggaatcaacccaatcatgatgagtgctggagagcttgagagtggaaacgcaggagagcccgcaaggttgatcaggcaacgttaccgtgaagcagctgacataatcaagaagggaaaaatgtgttgtttattcatcaacgatcttgatgcaggagctggacgtatgggtggaaccactcaatacacagttaacaaccagatggttaacgccaccctcatgaacattgctgataacccaacaaatgtccagctccc

SEQ ID NO: 1248 - DNA, 602 bp, Artificial
  Synthetic
ccccgagccaagaggggaaaaaaaaagggaagaaatttttttcttttttttttgttcgcctccgcttcttcctcacgcagctctcgcctcgcctcgccgcccgccactagagaggagagggagaaggagaaggaggcgaatcccagcaaaagaagatgcagatcttcgtgaagaccctgacggggaagaccatcaccctcgaggtggagagcagcgacaccatcgacaacgtcaaggccaaaatccaggacaaggaagggatccctccagatcaacagcgtttgatattcgccggcaagcagctggaagatgggcgcacactggccgactacaacattcagaaggagtcaactcttcacttggtcctcaggctcaggggtggcactatgatcaaggttaagaccctcactggaaaagagattgaaattgacattgagcccaccgacacgatcgataggatcaaggagcgtgttgaggagaaagaaggcattcctcccgtgcagcaaaggcttatctatgctggtaagcagcttgccgacgacaagactgcgaaggactataacatcgaaggtggctctgtcctccatcttgtccttgctctg

SEQ ID NO: 1249 - DNA, 610 bp, Artificial
  Synthetic
cccggagcagcagcggccggccatcatcagtgatcctctacaatcatcgactttcagcaaattaagatggctgctgccttctcctccaccgttggagctccggcgtccactccgaccaacttcctggggaagaagctgaagaagcaggtgacatcggcggtgaactaccatggcaagagctccaacatcaacaggttcaaggtgatggccaaggagctggacgagggcaagcagaccgaccaggacaggtggaagggtctcgcctacgacatctccgatgaccagcaggacatcaccagggggaagggtttcgtcgactcccttttccaggctcccacgggtgatggcacccacgaggccgtcctcagctcctacgagtacctcagccagggtctcagaacgtacgacttcgacaacaccatgggaggcttctacatcgcccctgctttcatggacaagctcgtcgtccacatctccaagaacttcatgaccctccccaacatcaaggtcccactcatcctgggtatctggggaggcaagggtcagggaaaatccttccagtgtgagctcgtcttcgccaagatggggatcaaccccatcatgatgagcg

SEQ ID NO: 1250 - DNA, 588 bp, Artificial
  Synthetic
ccccccccgagcaagcaaaggaaagaacttgccttgcaccaccacctgatcagagaagtagctagctgcaggagagaaaccgaccaacaatggcggagtactactccagcaccgtggacgagtgctacgagaccaccggcaggcagcacggccacgggcacggccacggtcacgggcacgggcacgggcatggtggcatgagggtggagtcccacaccgacgactactacagcgagggcggcgagatcgaccgtgggaggaggaacaactccatgcactcgcaggagtacctgatgaggcagcagagcggccatggcggctacggctacggcggcggccagcagcaggagtactacaagcgggaggagcgcgagcacaagcagcgcgagcgcgtcggcgagatcggcgccctcgccagcggcgccttcgctctctatgaggggcaccaggcgaagaaggacccggcgaacgcgcagaggcacaggatcgagcagggcgtggcggcggtggcggcggtgggcgccggcggctacgcctaccacgagcaccgcgagcagaagcaggccagctacggcgccaaggagcagc

SEQ ID NO: 1251 - DNA, 682 bp, Artificial; identical to SEQ ID NO: 902
  Synthetic

SEQ ID NO: 1252 - DNA, 494 bp, Artificial
  Synthetic
attcacctcatgttctgcttgcaaagtttcaatacactggagtgagtcagtgaggttggtgaagcagagtgaggaaaggaggatgggaagggtggcgcctagcgtcgaggaggtcgggggcgagcagccgccgcccgcgcttgggcccggcgagaccgtgagcgggacggtggccgagctgagggcggcgtacgagagcggcaggacgcggagcctggagtggaggcagtcgcagctccgggggctcctccggctcttggcggaggaggaggccgccgcgttccgggcgctccgcgaggacctcggcaagcaccaagccgaggcctacagagacgagatcggcgtgcttgtcaagtcggcgaacgccgcgctgcgtgaggtcgggaaatggatggcgccggagaaggtctgggtgccgctaatcgcgttcccggcaagggcgcagctggagccgcagccgctcggggtcatcctcgccttctcttgctggaatg

SEQ ID NO: 1253 - DNA, 613 bp, Artificial
  Synthetic
ccaagatgcagatcttcgggaagaccctgacggggaagaccatcacgctcgaggtcgagagcagcgacaccatcgacaatgtcaaggccaagatccaggacaaggaaggcatccctccggaccagcagcgcctcatcttcgccggcaagcagctggaggatggccgcaccctggccgactacaacatccagaaggagtccacgctccacctcgtcctccgcctccgcggtggcatcatcgagccctccctccaggccctcgcccgcaagtacaatcaggacaagatgatctgccgcaagtgctatgctcggctgcaccccagggctgtcaactgccgcaagaagaagtgcggccacagcaaccagctgaggcccaagaagaagatcaagaactagagtttgagatatcatttccgcggatcattgaaatcaacaggaagatcagagtttaagtttttttgtagtgtaatgcctcatgttgtatgccgaactttctgtttatcctgttgtatgttaaccttggttacgctggagagtactccagcttattttgatgacataattgactacaaagtcaaggttatatggtccggccttaatttttgtccccttcg

SEQ ID NO: 1254 - DNA, 545 bp, Artificial
  Synthetic
cttattgtcacttccatctcattctcctaatggtcatcactagcttctagctagcttaattaattaattagccatggcggaggagaagcaccaccaccacctgttccaccacaagaaggacgacgagccggccaccggagtagactcctacggcgagggcgtctacacgtcggagacggtgaccaccgaggtggtcgccggcggccaggacgagtacgagaggtacaagaaggaggagaagcagcacaagcacaagcagcacctcggcgaggccggctccctcgccgccggcgccttcgccctgtatgagaagcacgaggcgaagaaggacccggagaacgcgcacaggcacaagatcacggaggagatcgcggccacggcggcggtcggcgccggcggctacgccttccacgagcaccacgagaagaagaaggaccacaagagcgccgaggagtccaccgggcgagaagaagcaccacctcttcggctgatcgacctcatcacaacgtcgccggcgggggcgacgacctcgccgtacgtcgccg

SEQ ID NO: 1255 - DNA, 172 bp, Artificial
  Synthetic
cctctttttttttttagcaattatacattaaaatcacctcatcacctgcggatactattatgcctattaattactcgaccggcaaaagccatcccagcatcctctttcggtaaagcagtggccttcacatgcaaacatcggctatcgcaactaacacccccttcccctgtcc

SEQ ID NO: 1256 - DNA, 648 bp, Artificial
  Synthetic
gaattcaggagggtttttgttagggctgatttgaatgtcccgttggatgacaatcagaacattactgatgatagggagaatccgtgctgctattccaactatcaaacatttgatggccaatggtgctaaagtcattcttaccagtcatttgggaagaccaaagggtgttactccaaaattcagcttggcccctcttgtccctaggctctccgagcttcttggcatcactgttgagaaagctgatgattgtattggccctgacgttgagaaattggttgctgcactaccagaaggtggtgttctccttcttgaaaatgtgagattctacaaagaggaagagaagaacgaaccagaattcgcaaagaagcttgcttccctcgcagacctatatgtcaacgatgcctttggaacagcacacagagctcatgcttcaactgagggagttaccaaatacttaaagccatctgttgctggtttcctcttgcagaaggaactggactatcttgttggggcagtttcatccccaaagagaccatttgctgccatcgttggtggttccaaggtgtcatctaagattggtgtgattgagtcgttgctagagaagtgtgatattctacttttgggtggaggtatgatcttcacattcta

SEQ ID NO: 1257 - DNA, 715 bp, Artificial; identical to SEQ ID NO: 599
  Synthetic

SEQ ID NO: 1258 - DNA, 502 bp, Artificial
  Synthetic
gaattccaaagtagtactcagattgcagaagtctgatcagacatgggtgctgctttctcaaccgttggagcagttaacatagcacctttgagcttgccaagctctggccaaagctctgccttcttgggcagcagcttgaagaaggtcaattcttctgttgcaccaaaaccatcatcaagaagcttcaaagttgttgctgcacaagaggttgatcctaaaaagaatgaggacaaatgggccggtctttactacgaccagtctgatgatcaacaagacatcaccagaggaaagggaatggttgactcccttttccaagctcctatggataccggaactcacaatgctatcatgagttcttatgaatacgccagcaagggacaaagaacatacgactttgacaacaccatgagtggattctacattgctccagctttcatggacaagcttgtggttcacattaccaagaacttcatgacccttcccaacatcaaggttcctctta

SEQ ID NO: 1259 - DNA, 589 bp, Artificial
  Synthetic
caccacaattcaaatattatagttgaagcatagtagtagaatccaacaacaatgaagatcattttcgtatttgctctccttgctattgttgcatgcaatgcctctgcgcggtttgatcctcttagtcaaagttataggcaatatcaactacagtcgcatctcctactacagcaacaagtgctcagcccatgcagtgagttcgtaaggcaacagtatagcatagtggcaacccccttctggcaaccagctacgtttcaattgataaacaaccaagtcatgcagcagcagtgttgccaacagctcaggctggtagcacaacaatctcactaccaggccattagtattgttcaagcgattgtgcaacagctacaactgcagcaatttagtggtgtctactttgatcagactcaagctcaagcccaaactctgttgaccttcaacttgccatccatatgtggtatctaccctaactactatagtgctcccaggagcattgccactgttggtggtgtctggtactgaattgtaacaatataatagttccgtatgttaaaaataaagtcatacatcatcatgtgtgactgttgaa

SEQ ID NO: 1260 - DNA, 612 bp, Artificial
  Synthetic
cccacatatcagacacccgagagagtcaagatgtcggccaagcccacgaccaagcagttcgggaagtcgacccgggaggttcccgcctccgcggaccaggcgaagaagtggtaccctgccgacgacgagagcgccccgaagaaggttcgcaagtccgtccgaacttgggccccccgaaagaccctccagcctggtaccgtcctgatcctcctcgctggccgcttccgcggcaagcgtgtcgtcctcctcaagactcttgaccagggtgttctcctcgtcactggtcccttcaagatcaacggcgttcccctgcgaagagtcaacgcccgatacgtcatcgccacctcctacaaggtcgacatctccggccttgacgccgccaagattgaggagatctctcagcccaagtacttcaccgccgagaaggccaaggagaaggcttccgctgaggctttcttcaagcagggagagaagccccagaagaaggagatcaacagcagccgtgctgctgaccagaaggccgtcgacaaggctctgcttgctagcatcaagaaggtggatctgttggccagctacctcgccagcaccttcagcctgcggaagggtgacaag

SEQ ID NO: 1261 - DNA, 582 bp, Artificial
  Synthetic
  misc_feature (204)..(204): The residue at this position can be any nucleotide.
  misc_feature (214)..(214): The residue at this position can be any nucleotide.
  misc_feature (244)..(244): The residue at this position can be any nucleotide.
  misc_feature (252)..(252): The residue at this position can be any nucleotide.
aattgttgggccttttgagatccggagtgcggtttgcacacacgggccggccacgaggggctgcggcaggatcccaagacgccgagagccatggagagaatatctgggtgtttgcccacagaagatcagaacaggtcatttacagcttcaccaagcaattggatgggttccatggcctgaaactagctgccgttcaacggcaangaagaccaangcctgcaagagcttcgcacaagactactgngtcaccgnctcgcccacattcgattccagcccggccaaggatccgtcggccgctcggtattccagaagctgcgagagctgaagcaccttcacgaggttgcatggacagacgagttgcgacataagcggccggaacagtacaccagccaggacaagaagaagattgccgaggagaaggaaaagggattcgattaccaaccaatccggagcaagcaggagcgtggaatcgctctcaacgcccagaagcaaaatgcgattgccgatatggcatccgttttggcgggcgaaggccgtggcaacaaggtcttgaccgcggaggctgaaggaggcgagaaagag

SEQ ID NO: 1262 - DNA, 587 bp, Artificial
  Synthetic
aatctcgttcccaatcaactccgtctgcctctctcgcccgcatcaacaacattgcgagccacatctctcccacaatggcttccaccaccagtttcccggcagaaacggtgccccaggcgcctgaagatcccctctttggcctggcccgcgcctacaaggctgacaacagcccgctaaaggtcgacctgggaatcggcgcctaccgagataacaatgcgaagccatgggttcttcctgtggtaaagaaggctgatgagattctccgaaacaaccccgaactgaaccacgagtatgccccgattgcaggtatcgagagcttcaccagcaaggctgcggagctgatgctcggcgccgattcgcccgctctcgcggagcgccgcactacgtctatgcagaccatctcgggaaccggtgccgttcacttgggagctctgttcctcgccaagttttacaaaggcagccagaccgtctatgtgtcaaatcccacatgggcaaaccaccatcagatcttttccaatgtcggcatcaaggtcgcccagtatccctacttcagcaaggagacccgggggctggactttgatggcatg

SEQ ID NO: 1263 - DNA, 633 bp, Artificial
  Synthetic
gtatcttcacagtggcatgaaacgatggccgttggacaaacgccaccaccgctcccatttcccgttctcgttggccgaatgtcaaaagctggcacagtacgaacgccgagacaagtgagaggagctgctccccggcttttcccaccccgcactatgtgcgccttaggggggcaaaccgcgggaaatctggggtaaatcaggccataagtcgagatttcttcggcgctagctatctggcaaaggttttggaatccgttctagagctcgagggcccttgcgtgggctggtacgaaaaagtaagactgcagcggtaagatatcgaagggtcgatggacgttgttgggacaatgggttgcattttctgactgcgctgcgctcgacctgcatcccccgtcaggccccgtacatcggccagccctcaactggacggacggcctatgtgggtaatgcgagtacggcggtcgggctaaaatgtcgcgatgctgggttagggttcaaatttcttcagccagcgagcctcacgttgcggtgattgcacagggaatgttctcccatctgccggagcagccagtcgctagcatcgttcccgtacaagtactagaaggcaaacccttggtgagctagcacacacag

SEQ ID NO: 1264 - DNA, 522 bp, Artificial; identical to SEQ ID NO: 1183
  Synthetic

SEQ ID NO: 1265 - DNA, 489 bp, Artificial; identical to SEQ ID NO: 1146
  Synthetic

SEQ ID NO: 1266 - DNA, 501 bp, Artificial
  Synthetic
attcagtcatcttcggcagacaggcaaggagcaccgaatctccccgcggataaggcttctttttttccgtctacaaaacgtcacctgtgcaacaactgaaagctctctggcttctccgattcggcggtccaggcctctctttccacctcttccaacgtttctttcaaccctctccctttgatcaggcatttcaggataccgcttctcgtcctcaccggcgatctccgacgagccaagatgttgaacatatggtctatgaaaaaaaagcaaaaggaggctgaaaatgccgaaggtcaggctgctggagggaagaggaacaaggtgacggcggcacagctacgagtacaaaaagatttgtcagaactatctctcggcgcaacgatgaagactgacttccctgaccccgacaatatcctcaactttatcctgtcgatcgagccggacgagggcatgtaccgaggcggaaaattcacattcgactttgccatcaaccagaacttc

SEQ ID NO: 1267 - DNA, 455 bp, Artificial
  Synthetic
tgtcttgtcattatactcgaccacgcgtccgcaattctggatctgcttgagccttctttcttcactgtccgctcccaattgtcgcctcggttccacggcttcggattggaacacgcgcccacagacagaacgctccgtttcccattgagcgtcaacctctactgagctttcatcaatcagtacgaggccatcttcgacaattttcagaaaaagaaaaaagcctttcgagaacatcaattcggaaagaagagccacttcttcaccatggctgatgatgagaagcacgttgcggagcctgccatttcggacgtcgcccccgtcgactcctatgcggctgcccagaacgagtttcatgaccggcctcccggatggatttacaagggccacaagatcttcggtagggagatctactatgcctcacccagagtccagctcgtgctggttgctctcgtgtg

SEQ ID NO: 1268 - DNA, 529 bp, Artificial
  Synthetic
ctttttgatatctcaaaactccccaaacaacccacatcaatcatcatgactggacgcggcaaaggtggcaacgggcctcggcaagggtggtgccaagcgtcaccgcaagattcttcgtgacaacatccagagtattaccaagcccgctatccgacgtctcgctcgtcgtggtggtgtcaagcgtatctctgccatgatctacgaggagacccgtggtgtcctcaagtccttcctcgagggtgtcatccgtgatgccgtcacatacactgagcacgccaagcgcaagaccgtcacatcactagacgttgtctatgctctgaaacgacagggccgcaccctgtacggtttcggtggttaagcgatctgccactaggtcgggtcgacataatgtgttattcgcgtgtttgttacgattgggcttttcactatgggcgcgggtcattgctttttgagatttcgtactgtataacgtactgggaaatgggtgacccccgaaagggggtaattgagacttattcagtggtgacct

SEQ ID NO: 1269 - DNA, 605 bp, Artificial
  Synthetic
gcctcgctgctactctcaattgaactcgactcgagctccgtcaatcgcaaatccctacaagatgctgcgctctatggttctacgaggcaatgccttgacgcagaccacccgactggctgcatccagggccatgtcgagccaggcgctctccaacccgaccctgtccaacatcgagaaacgctgggagggaatgcctctccaggagcaggccgacctgtggatggccctgcgtgaccgcatgaagggcagctggaacgacctgaccctgcaggagaagaaggccgcttactggatcgccttcggccctcacggcccccgcaccgttgacgctcccggagccggtgcccgtgttgcctggggagttgccgttggccttgccgcctctctcgctctcttcgctgccatccgagttgccgccaagcctgcgccttacaccatgaacaaggagtaccaggaggccactaacgagcttctcaaggctcaaggtgctgatcccctcactggtatctcttctcccggctatactggcaagggtgtcgtgcagtctcctcccaaaaactaaaataaaacacgataatatcgcttcaagcttcgcacaattgggg

SEQ ID NO: 1270 - DNA, 198 bp, Artificial
  Synthetic
gaaagctcatcaacggcacctgagcagggtccaattgctctgttcagctcacttaagctttcaagatgcctagagacggcgagtaaacaaccgccctcagcggcgacaaacctcatcgctggtggtggcgccggtatgatggaagccctcgcctgccaccctctagacacaatcaaagtgcgaatgcagctctctcgc

SEQ ID NO: 1271 - DNA, 301 bp, Artificial; identical to SEQ ID NO: 71
  Synthetic

SEQ ID NO: 1272 - DNA, 523 bp, Artificial
  Synthetic
gacaaatcaaaacaaccatgcctcacaaagggaagtcaaaaaagggcgaatttgaagcagaattcgatctcgcccctacagagaaagcgcgatctcttccagtaaacaaacgaaaagcggcatcaagttctggagagcaagtcacaaagaagcgtgccagaagctcattaagaggcaatgacactccgcgagcattcaagagaatcatggctgtggcaggggggaagaaaattagatcaggcttggatgatggtcaactcgagaaaacgactacgaaggctaccgatgtaacgagcgagaaacttcaaattcgtcccggtgaaaatttaggggcctttgccagccgggttgatgcgggtctaccagtatcagggcttgcgaagaaaaccagcacgaatgcagagggcaaagacgcattaggattgaaagtgtatcgcactcgcaaagagcgcaaaatgcacaaactctacgatcagtggagggcataggaatccaagatacgagaaaagagggaggaggagct

SEQ ID NO: 1273 - DNA, 598 bp, Artificial
  Synthetic
ctcaacaagcgacaaattatcgccagggtgctccaacgctcgctccgccatcgccagtatcctttggacccatactttcgctctacaacacacacaacccctcttacgcccacatagcttcggctacgtcaagtttcggcatcatgtctagcagagatcgccgtataatgaaggagctgcaggatctgaccgaggacaaggacacttccggcattcatgctgccctagaacaagagggctcgctgaccgctctcaagggctggttctttggccctggaaatacgccgtacgctggtggcaaattcgtgattcacattcagcttcccaccgactaccccttcaagccacccaagatgaagtttgagaccaggatctggcatcctaatgtcagcagtcagacgggcgtcatttgtctcgacaccctcaacaagaactggtcgcctgtccaaacgatcaagacggctctcctctccgtccgaatgcttctcgaaaacccaaacccctcagatccacaggacggcgaagttgcacggatgctgctcgacagtcccgactcgtttgtccagatggctcacgagtgggcagtcaggcacgccgg

SEQ ID NO: 1274 - DNA, 377 bp, Artificial
  Synthetic
gcttgatcgcatctaccgaactccggaggggtcgccaaaggttcgcacattgtattttcgaaagcgaacatacacatatacacaaacaaatacaatatgtcggacaaccctacgacaaacgggcacgacgcccttcgaagagaagctcggccgcctggctaagaaacccggcatcaaggacagcctcgtttaggaccgatcaaacggcgcacccctcaagaagaacgggcacatccacgcgctccacacggcgaaatcccgaaacgcgtcaacggcggcctcattctccaacgacgctcccgcatgcggacgagggcgaggcgcacggcgtcgaacagtttgcggaaatgatctgcaacttcgtcaacagctccggg

SEQ ID NO: 1275 - DNA, 429 bp, Artificial; identical to SEQ ID NO: 961
  Synthetic

SEQ ID NO: 1276 - DNA, 368 bp, Artificial
  Synthetic
ctcaaataaaccactcaatcgattccttgataccccttgggacaaatctacttgttctctccaaacttatccctccaaataccatcatcaccatcaccatgatcaaagatgtttctaccaacgggtcttctgccgctcctgctaccacctttgccctcaaggctggtctcgcccatatgctcaagggcggggtcatcatggacgtcaccaacgccgagcaggcccgcatcgtcgaagaagctggtgcctgcgccgtcgtggccctcgatcgagtgcccgccgatatccgcaaggacggcggcgtcatccgcatgtccgagccgggtatgatcaaggagatccaatacgccgtcaccatccccgtcatg

SEQ ID NO: 1277 - DNA, 146 bp, Artificial
  Synthetic
cccacgcgtccgcccacgcgtccgatcggtgggtttctttgggagcgttaatcgaccttgctcattcttcataccatcggcgtcgttggcatttatacggcatctcgtcttgtttccttcgtactcgaggtacggtaccctgaccg

SEQ ID NO: 1278 - DNA, 629 bp, Artificial
  Synthetic
aagaaacacaaacaagcaaatcaattcccgagcaagaaaaaaagaagaagcccatcatgaagatgctttcgtttgccgccctctcggtgctcgtgttgggcgcttcggccctggctgcgccgccggcccaccccccggccgacaatgggtgctgctgctgcgacatcaacaagaagagaatcgactgcgacaggtcgatcccggcgtcggagtgcatctgcccccaggtcatctgccccgccggcgcgcccacgttcacgcacggcacgccgccgaaagccaccccaccgcccacgccgctgccgacttacaagcagtgctgctgctgcaatcccaacattaacaagattgtgtgctcgctgaggctcgtggaggactgtatctgcttggccgtgatgtgtccgacggatgcaaagaccatctttgtcaggccaactggcgttccgactgtcgcttaagagtattcgttggcgagccgacttgcctgaatcctggaccggggacatgacatggggggagggaaaatacaggccaaggcattgctgatggtgaatgcacaacacgcgtggcagactggccgaaaattgatgatttactgatgggcgactttggacttgaaatggggcatg

SEQ ID NO: 1279 - DNA, 352 bp, Artificial; identical to SEQ ID NO: 87
  Synthetic

SEQ ID NO: 1280 - DNA, 236 bp, Artificial; identical to SEQ ID NO: 740
  Synthetic

SEQ ID NO: 1281 - DNA, 111 bp, Artificial
  Synthetic
gaagtcgattgccggaggcggtgccaacaccttctacggccgacctggtatcaacttttacacgcagctcaagacggtgacggcgttatggcagagcgccgatgccgtggc

SEQ ID NO: 1282 - DNA, 626 bp, Artificial; identical to SEQ ID NO: 107
  Synthetic

SEQ ID NO: 1283 - DNA, 407 bp, Artificial; identical to SEQ ID NO: 880
  Synthetic

SEQ ID NO: 1284 - DNA, 424 bp, Artificial
  Synthetic
tacaaacacttctcacatctcttccaccctaaggaatatccgttaacagtgcatcttcttgcactctctacgaatctcccagcggccaacgcttaatccgccaccatgcaaatcttcgtcaagatcctcagcggcaagagcatcaccctcgaggtcaagtcttccgataccatcgacaatgttaagtccaagatccaggataaggaaggcatgcctcctgaccagcagcgtctgattttcgctgggaagcaactcgaggatggccgaactctgtccgactacaacatccaaaaggagtccaccctccacctggtcctccggcttcgtggtggtatgcagatcttcgtgaagaccctcactggaaagaccatcaccctcgaggtggagtcatctgataccatcgacaacgtcaagtccaagatcc

SEQ ID NO: 1285 - DNA, 464 bp, Artificial
  Synthetic
atgaattccgcctcgcgacccggccaggggcaattgttgggccttttgagatccggagtgcggtttgcacacacgggccggccacgaggggctgcggcaggatcccaagacgccgagagccatggagagaatatctgggtgtttgcccacagaagatcagaacaggtcatttacagcttcaccaagcaattggatgtcagtttcgccgtttctatctccaactcacagcctgccgtatcatagtatctgactgggtgtcataggggttccatggcctgaaacagctgccgttcaacggcaagaagaccaagcctgcaaagcttcgcaaagactactggtcaccgctcgcccacattcgattccagcccggccaaggatccgtcggccgctcggtattccagaagctgcgagagctgaagcaccttcacgaggttgcatggacagacgagttgcgacataagcgg

SEQ ID NO: 1286 - DNA, 383 bp, Artificial; identical to SEQ ID NO: 129
  Synthetic
  misc_feature (381)..(381): The residue at this position can be any nucleotide.

SEQ ID NO: 1287 - DNA, 567 bp, Artificial
  Synthetic
gaagcaaccaagaatctgcacctcactcgataataaaaagaaatcggtactcaaggtttataactcattcaaaatgcgttatactgctgtcctcgctgtcctcggcttctccggagtcatggccaacaaaaacttcggacccttcggatttttcggaccctggttcgatggcgacttaactatcgatgacctcgctgactttcagtttcctgagaacccttgtgagttcattggtggtacttgcgagatcgccacttcccttacattctgcgctggtcggggcgacttcagcgttgatttgccttgtggcgttggcctcggctgctgctggcaccaggacaccagcaatgtttggtttgagcaatggaaggagtggctcgagctacacagccgcatcaactaaagccgctttaatgtcttgacgctttgatggcttgacgcttctatggcttgacgcttctatggcttgatgctttaatggcttgacggagtcttcaattggcacggtagtgggtgatggagaaattagccgtactgaactcaatgagagattgttaaccctgaaaa

SEQ ID NO: 1288 - DNA, 574 bp, Artificial; identical to SEQ ID NO: 131
  Synthetic

SEQ ID NO: 1289 - DNA, 598 bp, Artificial
  Synthetic
ggacggcagccatgaattccgcctcgcgacccggccagggccaattgttgggccttttgagatccggagtgcggtttgcacacacgggccggccacgaggggctgcggcaggatcccaagacgccaagagccatggagagaatatctgggtgtttgcccacagaagatcagaacaggtcatttacagcttcaccaagcaattggatgggttccatggcctgaaacagctgccgttcaacggcaagaagaccaagcctgcaaagcttcgcaaagactactggtcaccgctcgcccacattcgattccagcccggccaaggatccgtcggccgctcggtattccagaagctgcgagagctgaagcaccttcacgaggttgcatggacagacgagttgcgacataagcggccggaacagtacaccagccaggacaagaagaagattgccgaggagaaggaaaagggattcgattaccaaccaatccggagcaagcaggagcgtggaatcgctctcaacgcccagaagcaaaatgcgattgccgatatggcatccgttttggcgggcgaaggccgtggcaacaaggtcttgaccgcggaggc

SEQ ID NO: 1290 - DNA, 517 bp, Artificial; identical to SEQ ID NO: 141
  Synthetic

SEQ ID NO: 1291 - DNA, 594 bp, Artificial
  Synthetic
gaaaactcaaaattaaattaaacataaagacaggctcccaaaaggctgtgacctcttcttattacatctttacaagcctccatagcgtaagattccctccacaagggtcgggctgattttatcctgtcggaataatcacttgcgtaattcgacgtcgtttcgctcgcttcttacggcaagcctacaaatcccattccggcagcgagctcgcctggcgcgtgccaaaatacgacgaccgaaaacaccaagtgcatgtgccaacggtgattggatttgtgcgctccgagatacccaaaccaaaagtacatgttaggatgcacgcgaccacgccatgatcggcgcttgatcacgggcccataatcgagagagaggcgccgctaccggacgatagaacggagggaatagacagatagacgatagacgggacgagcgatcgatcaagtcagagacaacaaataccgagtggcgatgccttcatccgatagtcttgggaggcgggcctcacacggcgctgccagcctggcgacgtcggcatcttctatacacggcgcagcagttgggtttcgagaaggcctgggcttggctggagttgcg

SEQ ID NO: 1292 - DNA, 494 bp, Artificial
  Synthetic
tgtgagaacaagccacatcggggagacgggaagatggtgacacggatgcgtttgtggaggtgggtaagctttgcgcaacatgtgccagccttatcttgatattggacgcggcgacggcgagatggttggaagggtgtgtctatgtgtaccgacaaacgcatggctgatgagacggtgaataaaactgcaccaagaaagagatgcatgagagatgaatgaccagtacctaaggtctatgacatgtcgctttgcactcggtcggactcattcacatgtagtaaatactacataacacccacttgctccagtaatcatcacttataataatacggcgagaagacaagttgacacagggcgaaacagggcggaacaaggggcgaagcgaggtggaaaatggtaaacgcagagactctttctatgtactagccatcgatcaaaaggaaggacagctcagtcttcgctgcatgcgaaaaaaaaaagaaaaaagcactcac

SEQ ID NO: 1293 - DNA, 628 bp, Artificial
  Synthetic
gcattttggggtcgcaaatctacagcaaaaatggcctcgacaacgaccaagcagaccccggcgtcctttgtcgggaccagcaaggtcgtcgagactgactatccgctcatcgacaacgaccctcactttaagcgggttatcggatatgcgagaacgtcagactacgtagctggtgcaacctctgcggcctttgcaccgactgctctctatgccctcgagaggctcgccccgtcgcatgttggccggggaggctttgccaaagccatgcggttagccggattcattggcttggccggcggtttcctctacttttaccagcgatcagcccttcgattctacggcgccactgagaactcaagggaagtcgagatggatatgcgagagatggtttccaaggtcaaggcgggacagcctctgtatggcgagagcaagctgagccctcacctgcagggagttgcggcccgacagagcagatactctgcgctctttttcagcacagtaccgtggttcaactttgtcaaccacaaccagcacggcgtggacacggccaagtactatcagcaggccgagagggaactggaagcagagcgggcggcgggcaagagctagacgggaccaaatgtgtata

SEQ ID NO: 1294 - DNA, 548 bp, Artificial; identical to SEQ ID NO: 199
  Synthetic

SEQ ID NO: 1295 - DNA, 350 bp, Artificial
  Synthetic
atcaaactcttaatctctattcttaaatacatctacctctcacaatggatttcgtcaacaaggctatgggcaaggaggagcgctccactcagggcaccgctcccgctgctccccaagcaggcggccaggtccagaaggacgattacgtcgacaaggctttcgccatgggtgccaaaaagagcggccacaacatggatcgcaacacacaggagaagattacggatgcaggccgtaacatgtacgagaaggtgacaggaaacaaggtcgaccccaagtggtctaattaatgaacggacgagttatgactcacaacaagactgtacaatagtaataataacatcttatcaacg

SEQ ID NO: 1296 - DNA, 616 bp, Artificial
  Synthetic
attttaccagttgcaacaagccactgaatcaatcagaaaaaccatcaaacaagacaatcggcatcaatctaaatatcgagcactcatcaatcgaaatgatgccgctgcacaggccggaaacgccacaacccgaatcccctcttcccaccgagcccgataccagcgagggcgacggcactgcggattactgaggggcaacacaagctcaaactttgatgacgacaagggccgctcgggaatgagagaatacgaccgagtctaaatggcactcaagagcggcgtcgaaatgctggttgcggaaacgaactggggaaacgacctagattgaatagacatgctcggagatggcgcatggaggaaacgtctatgaagcgcatgtctttttttggctttctttgttttttctttttacggccgacgacgacacgatacgccgataacatatacacttgcccccgccactgcccaaagagcgcgattctgcgggggtagcagttttatcagaatgaatgcggattggaattgagcgagcgatgtacattattttgtcttttatttgattgagaaattctttcaattttttacgcatttatcatttgccaatgttgttgttgct

SEQ ID NO: 1297 - DNA, 526 bp, Artificial
  Synthetic
aaccctccagggcagctagcgaagagagcaggcccagttccgggtgacaggtcgggcaacgccgcgacggctgcgattccgagcgaacggcgctggcgttccagacggcacagcagcaagcacagcaacagcacagcacagctacgaacatcgaggatcccgctccaggaaccggtgctatccagaacaaggccccggcgctaggacccgcggttggcagtggtggatcgcaaggctccagtcatgccatgcaagcgagggaaaaacgcttgcatgctcatgctttgctctggctctagatgagtctgaatctcatccatcctcgacctgctgctgtgtctccccgtcccgcacgaggcttcggtcggcgagagccgggatcgaggcgttgggggatggcgtctgtgagccagacatgacctgtcacagcgctgcgtcgatgatgaaaatggcctgatttcttgctcgcggagctatgccgggaccctgcaaccgcgaaatgggctgccaccggccacagagaaaa

SEQ ID NO: 1298 - DNA, 653 bp, Artificial; identical to SEQ ID NO: 857
  Synthetic

SEQ ID NO: 1299 - DNA, 635 bp, Artificial
  Synthetic
aagccctcacctcacataaacacgggagaactacattcaagatggatttctctaaattcagcaagggtttctctgatttcagtgcgcagattactccgtttgcgtcacggaccttccagtttaccaaggagcagttgggccaagcagatgatcgaactgagcttcctgccgattacatcgacctcgagaaaaaggtcgatgcgctgaaacaagcccaccagaagatgcttgcggtgacttcgcaatataccaacgaagcctatgactatcctcccaacatcaaggagacatttcaagatcttggccgaaccgtgagtgagaaggtcagccttctatcttcggctacatctacttcagaggcccaagcagctcttgtggctccagcatctgcgaagccgcaaccaaagactttcaaccatgccatctctcgtgcgagcttatccagcagccagctcctgcaccagcaccacactggtgctggcgaagatcctctggcaacagctctcgagaaatatgcactcgcgatggaacgagtgggcgacgcgcgccttgctcaagattcacaaatccaaagccgattcctagcaggatggaacacaaccctcaataccaatcttacctttgcggcgcgtgct

SEQ ID NO: 1300 - DNA, 317 bp, Artificial; identical to SEQ ID NO: 796
  Synthetic

SEQ ID NO: 1301 - DNA, 529 bp, Artificial
  Synthetic
gttttccaaggatttactccagcttgcaggggccaagatgtcactgcatgggggtttcgttaatgaagctgttcagggcatgatatggtgcatgaggatgcacgagtggatactaacatatgacagttgatgctctttttatagagcatccgtttggatataaaagcatcgagtgtcgccaacattttgatcttgttccatccatcaatcgcatcaaccactctcaagcaacaataacaacctttacccaacttcaaagactttcagtctctcaactcaacaccttcaagatgtctccctgcgcatgcaactcctgtggatgcaaggacaactgctccagctgctcctgcaccagctgcagccactaaatcatcgtgctctttttccttcgctggatctatactctctcggaatgacagcttgagggctcggatgtgcttaagacgccatgggaagggcaaggcatttgggcgaatagacctccatcatgtgggatatagcagaataggaatttgaagattttgcccta

SEQ ID NO: 1302 - DNA, 584 bp, Artificial
  Synthetic
  misc_feature (505)..(505): The residue at this position can be any nucleotide.
ttcgcctgttgctcggaacatgcggattgccggctgagcagttcaagcgaccaagccagagccgagcctctgaatttcatgcatcaatctgacgtctttgaccgctgagcctctggatttccgcaaaccgcagcagcaatataacaatccttcttcttcttgttcaattacgactgtaccaatattcacaatggttctcacgcactccaccaatcacacctactcccaccctttcccgaccgtcaccctcgcctacttcctgcgatactcttcgcctcagctcaatcccttcgccgcccatgtcctcagcaccgacaccatctctagccatgtcgacccggaaacccagcgcctctacaccacccgcatccacctgaagaagagccgcatgcctagcgcagtctacaaactgctgcccgcaagcgtttcaggtggcaactctggcgagaaggcttcctacattctcgagaccagtgttgtggacatcaaggaaggatggatgaanacggagagccgcaacctcaatttcactggtgtactttccgttgtcgaaaagcaacacttcaaagtccccagctcacttg

SEQ ID NO: 1303 - DNA, 596 bp, Artificial
  Synthetic
tttactccgcgatcttcttgatcttcaccaaaacaacatcattgcgcccttgaagccctcttagcaaatattcgatatacccaaaaggcattgagcccttgagccttacgagaaacacatatatccaacatgcctttcaccgctagcgatatctgcaagattattcttgccatcattctgccacccgtcggtgtcttcctcgagcgaggctgcggtgcagacctcttgatcaacatcctcctcacaatcctgggttacttccctggtatcatccacgctctgtacatcatattgaaatactaagcccgccttccgctcccgtatcccgccggattcaaagcgtcatgtcgtcgcaccgcatcatgttgtgcagacaccaattactcccacgtttgaccggcaattgtcgttttagaatggatgcgtcagtggaggagtgaaggttacggtcgccggctcaccacgtggccggtcatagacgccataatgacagtgggctttcctttatggcttttcttttgttttttcttttcctctcttgttggctggaggcagatgcaccctatttgaaagggggcgtcaggtttggctattgt

SEQ ID NO: 1304 - DNA, 471 bp, Artificial
  Synthetic
cccacgcgtccgcgcaagcgaaaaaggattaatcgcaactccgagatcctgctgaatcacaatgagacctactcaggttcgtctgggcggcggcgcccctcaacccaagactggccactggctcggtgactggggctcctttggtggtgccaagcagaagggcattatcgactacgggctgtctgccaaccgtcagaacccctttgccggtgctgcccacgatgccatcttcaacaccttccgccgcaccaagtcccagatcttctactggctccctcctatgctggctggctactacctgctgagctgggccaccgagcgaaaccactacctcaactccaaggctggccgtgctgagtttgccgactcggagtaaaatggtgcacgaatatgttgaattatgggtgtccaggggacacagtgtatatcagcgtctagattaggagaaaacaatagaaacgtttgactcta

SEQ ID NO: 1305 - DNA, 633 bp, Artificial
  Synthetic
aataacctacgccgtgtcagtcaagcaggtgtacatcatcgcatatcgaccgacgacgaccttgtcctgcgtcttccatctccaattctcacccaccacttacaccatcacacatcacaatgcctgctcctcaggttaacggcgaggtcaccagccatgtcaattccgccttcctccaggtatgcatggataaaagaagagattcgccttgtcatcacacaatggcaaatgcgaatcgaaccgaatcgtgatggctttggtccggttattgatcatattggcagcacctcttctcctatcctctagttagcgacggcattcacactgtgaccaccaacgaatacgcacagcggcctatcaagctgggcgaatctgcctataaaacttttgccgcccctgttcttccctacttttccaagccctatggtattgtctctccctacgtccagagggccgactcctttggcgacaagaccctggaccgcattgacgagcgttttcccattgtcaagaagcccactggtgatctctacaacgagacccgtggtctgattctgttcccctaccagaagggactcgagggcaaggagcacgttttcaagatctatgcttccgagcttaagaagcttgagc

SEQ ID NO: 1306 - DNA, 647 bp, Artificial; identical to SEQ ID NO: 286
  Synthetic

SEQ ID NO: 1307 - DNA, 397 bp, Artificial
  Synthetic
cacacacaactcaaccaggctttcaactctcaactacaccacaacttacaatctcatctcgcgaccaaccaactttcacaatggagactgtcaagcaagccgtcaactacgtcgctgagtccgtccagggcgctgcctctggtatcagcaaggagaccaacaaggagattgccaaggacagcaacgtcgacgtttccactcgtttgtccgctggcaaggacgcccttggtgacaagatcgacgagactggccacaacaacaaggccgaggctcacaagcagctggctgagcacaactagattggcataaggagcttcgattgcttcacaggcgttgaaccggatcagagcgaagggaatatatagcctcactaggcaggaattgatgatttgaattc

SEQ ID NO: 1308 - DNA, 646 bp, Artificial; identical to SEQ ID NO: 815
  Synthetic

SEQ ID NO: 1309 - DNA, 633 bp, Artificial
  Synthetic
gattgcttaggacggcaataggtctattggcgagttaggcaagatgcagattttcgtcaagaccctcacggggaagacgatcacccttgaggtggagtcttccgacaccatcgacaatgtcaagtccaagatccaggacaaggagggcattcccccggaccagcagcgattgatcttcgctggtaagcagctggaggatggccgaaccctctccgactacaacatccagaaggagtctaccctccacctggtcctgcgcctgcgtggtggtgccaagaagagaaagaagaaggtctacaccacccccaagaagattaagcacaagcgcaagaagaccaagttggctgtcctcaagtactacaaggtcagcaacgatggtaacatcgagcgtctccgccgcgagtgccccagcgagacttgcggtgctggtgtcttcatggctgccatgcctgaccgtcaatactgtggtcgttgccacctgacctacgtcttcgacaagcagtaaacgacaaaactttcaaaaagggaaaaaatttattgtggattggacagctggagccatgggactgccataacacacaaaggcgttgatgtagcattagagagcacatccggcggcttctggtaatgaat

SEQ ID NO: 1310 - DNA, 441 bp, Artificial; identical to SEQ ID NO: 301
  Synthetic

SEQ ID NO: 1311 - DNA, 542 bp, Artificial
  Synthetic
cacaaaaatcgttcaagatgcagattttcgtgaagaccctgacgggcaagaccatcacccttgaggtcgagtcctccgacacgatcgacaatgtcaagtccaagatccaggacaaggagggcattcccccggaccagcagcgattgatctttgctggcaagcagctcgaggatggccgcaccctttccgactacaacatccagaaggagtccaccctccacctcgtcctccgtctgcgtggtggtgtcattgagccctctctgaaggttcttgcctccaagttcaactgcgacaagatgatctgccgcaagtgctacgcccgtctccctccccgtgccaccaactgccgtaagcgaaagtgcggtcacaccaaccagctccgacccaagaagaagctcaaataaatcatttcaccaaggatgtggcgtctgggttatggcattctggggtggcgaggacagaggtgcttctgctttattccggattttgtttctacattagcatcagggcagaggcaaaatatatcaatctagatgatgtct

SEQ ID NO: 1312 - DNA, 575 bp, Artificial
  Synthetic
tcatccttttgcttccagcagctatcaagacttgacttaaaaaaaccagtcctcataaagacatctacaatcagtcaccatgcagatcaccaagagcctcatcgctaccctctttgccgcttcgaccgcctttgcggctcccactcctgcggacaagtccatgatggccgctgtccctgagtggacaatcaccaacctgaagagagtgtgcaactccggcaatacctcctgcacatggacctttggcgtcgatacacatctcgccactgccacctcatgcacatacaccgtcaaggctaccgccaacgcttctcaggccaccggcggccccgttacttgcggcccttacactatcacatccagctggagcggccagtttggccctaacaacggcttcactacctttgctgttaccgacttttcgaagaagctcatcacctggcctgcctataccgatgttcaagttcagggcggcaaggttgtttcgcccaaccagagctacgccccgaccaacctgccatagatggaatgaatttgcttggaattactatacgcaaggtcaatttactcccaaa

SEQ ID NO: 1313 - DNA, 310 bp, Artificial
  Synthetic
gtccgagattctgctgaatcaccttgagaccgaggcaggttcgtctgcgcggcatcgcctctcaacccaagactggccactggctctctgactgggactcctttggtggtgccaaacacaagggcattatcgactacggtctgtctgccaaccgtcacaacccctttgccgttgctgtccacgatgccatcttcaacaccttccgccgcaccaaatcccagatcttctactggttccctcctatgctggctggctactacctggtgagctggtccaccgagcgaaaccactacctcaactccaatgctgg

SEQ ID NO: 1314 - DNA, 471 bp, Artificial
  Synthetic
ctccaattgtcgcccgcaaatcgcccgctaccgtcgccgaagccgaatcattcatcatgtccgacgaggaaggccaggagcttgtcaccaagcccttcaagtttgtcactgctggcactgatgcccgtttccctaacgtgaatcagaccaagcactgctggcaaaactacgtcgactaccacaagtgcattctcgtttttggagaggactttgcgccttgccgtcagttctggttggcctaccgatcactgtgcccttctggatggtaccagcgatgggacgagcagcgcgagtctggtaacttccctgtgaagctcgatgcttaaattccatatttgaggtggcggggtacataagcaagggtgttcacatagattaagcagccaggcggcgcatgtgctgccagaaaatgtagtagtagtcaatcacaagcaaacaggctcaatgaaaaaaaaacacacaaaacccacc

SEQ ID NO: 1315 - DNA, 634 bp, Artificial; identical to SEQ ID NO: 1111
  Synthetic

SEQ ID NO: 1316 - DNA, 292 bp, Artificial; identical to SEQ ID NO: 856
  Synthetic

SEQ ID NO: 1317 - DNA, 117 bp, Artificial
  Synthetic
cgtatctgcggatgccggggatggactccggtgtacttggcacggctcgcttccgtttgacataaaaatgcagtgtaacaggtagatggacgtacatgtagatgtaaatgcggtact

SEQ ID NO: 1318 - DNA, 660 bp, Artificial; identical to SEQ ID NO: 611
  Synthetic

SEQ ID NO: 1319 - DNA, 707 bp, Artificial
  Synthetic
gtatcttcacagtggcatgaaacgatggcctgttggacaaacgccaccaccgctcccatttcccgttctcgttggccgaatgtcaaaagctggcacagtacgaacgccgagacaagtgagaggagctgctccctggcttttcccaccccgcactatgtgcgccttaggggggcaaaccgcgggaaatctggggtattttatgccataagtcgagatttcttcggcgctagctatctggcaaaggttttggaatccgttctagagctcgagggcccttgcgtgggctggtacgaaaaagtaagactgcagcggtaagatatcgaagggtcgatggacgttgttgggacaatgggttgcattttctgactgcgctgcgctcgacctgcatcccccgtcaggccccgtacatcggccagccctcaactggacggacggcctatgtgggtaatgcgagtacggcggtcgggctaaaatgtcgcgatgctgggttagggttcaaatttcttcagccagcgagcctcacgttgcggtgattgcacagggaatgttctcccatctgccggagcagccagtcgctagcatcgttcccgtacaagtactagaaggcaaacccttggtgagctagcacacacaggtactccgtgccagcaaatggacatggtcatggattagtagatcaacattggaacagagtcatggctactgta

SEQ ID NO: 1320 - DNA, 537 bp, Artificial
  Synthetic
acaagccaagcacatcacagacaaaatggcgcctgcagctggagcaaagaagcaaaagaagaagtggtccaagggcaaggtcaaggacaaggcccagcacgccgtcctgctcgacaagaccatctccgagaagctctacaaggatgtccagtcttaccgcctcgtcaccgtcgccgtcctggtcgaccgaatgaagatcaacggctccctcgcccgccagtgcatccgcgacctcgaggagaagggcatgatcaagccggtcatcactcatagcaagatgaagatctacacccgtgccatcggcgagtaaatttaccaccatgtttgaaagttaaagcattgagatttggcgcctggttggtctgaaaggaagaaaatgggaccatgagtgaagaggatgatacgaggtatataaagccttagttgggacgcttttcatgctcggtgtagcatttcatgggaaccggaaacgctttagcaaatggcaacggaatgaagaacttcaaaaaacaaaaaaaacaaaaaaaacaaacacac

SEQ ID NO: 1321 - DNA, 544 bp, Artificial
  Synthetic
accactctcaagcaacaataacaacctttacccaacttcaaagactttcagtctctcaactcaacaccttcaagatgtctccctggtgagtcttctgaggaccattggtccatcacttgctcgggagttcctctttgctttaccttcagcgttccactacctgatctatgataccttctttcccaccaccgagcaaagcactcattagacatgtcactaacgattttctttcaatagcgcatgcaactcctgtggatgcaaggacaactgctccagctgctcctgcaccagctgcagcgtaagtcctgcttctctcccctgctttgggcattgagaaacttttccaccagaaagctaacagatgggaacatatagcactaaatcatcgtgctctttttccttcgctggatctatactctctcggaatgacagcttgagggctcggatgtgcttaagacgccatgggaagggcaaggcatttgggcgaatagacctccatcatgtgggatatagcagaataggaatttgaagattttgccctaac

SEQ ID NO: 1322 - DNA, 129 bp, Artificial; identical to SEQ ID NO: 348
  Synthetic

SEQ ID NO: 1323 - DNA, 487 bp, Artificial
  Synthetic
cccacgcgtccgcccacgcgtccgcccacgcgtccgcgccaaacaacgcatcttacggcttcacaacagcttggaaagctctctattcgcaatggctatcgcaccgatcactggaatgctgcggcgacagctcatccttgacctcggcgttggtcttggatccggattcatcatggccaactggtactggtacggctaccacattgccccgaaccaacggccgagacgcctactacgccaagaaggaggccgaccgtgccgccgcggcatcacagtaaggggggcacttgtatactcgatggaccgagagggaatgcggcatgaacaactgctggtcgaatagaaggggaatgactgggccaacgggctgttcatgcctgcaggagcatagttgctggacagatgtcgaatatcactgaagaaaggcaaccgggcgaacctctacttagaccaataagtcgcggggcaatacgattcaattatctct

SEQ ID NO: 1324 - DNA, 215 bp, Artificial; identical to SEQ ID NO: 352
  Synthetic

SEQ ID NO: 1325 - DNA, 384 bp, Artificial
  Synthetic
tctcaagcaacaataacaacctttacccaacttcaaagactttcagtctctcaactcaacaccttcaagatgtctccctgcgcatgcaactcctgtggatgcaaggacaactgctccagctgctcctgcaccagctgcagcgtaagtcctgcttctctcccctgctttgggcattgagaaacttttccaccagaaagctaacagatgggaacatatagcactaaatcatcgtgctctttttccttcgctggatctatactctctcggaatgacagcttgagggctcggatgtgcttaagacgccatgggaagggcaaggcatttgggcgaatagacctccatcatgtgggatatagcagaataggaatttgaagattttgccct

SEQ ID NO: 1326 - DNA, 615 bp, Artificial
  Synthetic
agtccagatagtcaacagatcaaacacaagacaaacctgcctgttcgattactttgcctccttgtagtacaattcgcaatagttcaccaaatcaccagtcatcatgcctgtcactgagtttgccattatcaagctgaggcccaatttcgaccccctcgagtttctcgagacactcatggagtgtcaagagattcaggacaattggattcgccgcaatcagccatgcaatctggcgcctggcatgaacctgagcagcatgtacacggatgccacagaccaatcaacacttctcatcacggcgccgtgggattcgcccgaggggcatggggaatggatccagagtcttgagaacaggacggccaatggcaacttaaccgagttcagcgctccgggttgcgactccgtcttgctcttccacatggacccggcgggagcgaggccacagatgcgggaagcctttcagcacaaggataccaacgacgtattcgacgtctgtcgcttaacattcaacggcgatcagcgggaggcaatacaaaccaaatatcaagcactggaaaacgagctgcgaaaggaaggtctggagaagagcatatgggcgggctggaggattgaaaa

SEQ ID NO: 1327 - DNA, 182 bp, Artificial; identical to SEQ ID NO: 780
  Synthetic

SEQ ID NO: 1328 - DNA, 671 bp, Artificial
  Synthetic
aaacaagcaaatcaattcccgagcaagaaaaaaagaagaagcccatcatgaagatgctttcgtttgccgccctctcggtgctcgtgttgggcgcttcggccctggctgcgccgccggcccaccccccggccgacaatgggtgctgctgctgcgacatcaacaagaagagaatcgactgcgacaggtcgatcccggcgtcggagtgcatctgcccccaggtcatctgccccgccggcgcgcccacgttcacgcacggcacgccgccgaaagccaccccaccgcccacgccgctgccgacttacaagcagtgctgctgctgcaatcccaacattaacaagattgtgtgctcgctgaggctcgtggaggactgtatctgcttggccgtgatgtgtccgacggatgcaaagaccatctttgtcaggccaactggcgttccgactgtcgcttaagagtattcgttggcgagccgacttgcctgaatcctggaccggggacatgacatggggggagggaaaatacaggggcaaggcattgctgatggtgaatgcacaacacgcgtggcagactggccgaaaattgatgatttactgatgggcgactttggacttgaaatggggcatgccggatgggttacttgacagtatttacaccatttctattcaacaataaat

SEQ ID NO: 1329 - DNA, 611 bp, Artificial
  Synthetic
aagcctcttcgaccaccctctgccatcgtcagccttcgactctcttcaccaaacctcaacaagcgacaaattatcgccagggtgctccaacgctcgctccgccatcgccagtatcctttggacccatactttcgctctacaacacacacaacccctcttacgcccacatagcttcggctacgtcaagtttcggcatcatgtctagcagagatcgccgtataatgaaggagctgcaggatctgaccgaggacaaggacacttccggcattcatgctgccctagaacaagagggctcgctgaccgctctcaagggctggttctttggccctggaaatacgccgtacgctggtggcaaattcgtgattcacattcagcttcccaccgactaccccttcaagccacccaagatgaagtttgagaccaggatctggcatcctaatgtcagcagtcagacgggcgtcatttgtctcgacaccctcaacaagaactggtcgcctgtccaaacgatcaagacggctctcctctccgtccgaatgcttctcgaaaacccaaacccctcagatccacaggacggcgaagttgcacggatgctgctcgacagtcccgactcg

SEQ ID NO: 1330 - DNA, 517 bp, Artificial
  Synthetic
caaaatcgcagcacaacgtatcatcatgccgtcagcttctgaaaaggcgagagcaaagctcgatgcggtgttgaacgacccgggacgatttgactgtacccaacggtcgaatcgcatagcgacgacacgatatgctacaggctgtggcgtagtcaactctgttccgcgtcgccccagccagagtagcatagaaagcgattcaggcggcgtcaggaacagactgaaacgcctcatgtccttacccgcgtactaaagcgaaaaaaaaaagtgactggagaaatattcttgatatggataacaacctcgatggttgtgaacagtttcatatgtcctagtgtcccatcgagcaaaggttgcctgtctattggcacgctcgtactttatctcgtgcctccttggcaagattggaagatgtacacatctcttaacctgaatttctctccgaagagcattgaggatctgttgtagtccatctctgtagcagacatgttagatgcaatgaatttttatccgagaa

SEQ ID NO: 1331 - DNA, 490 bp, Artificial
  Synthetic
gtcctctcaatctcgttcccaatcaactccgtctgcctctctcgcccgcatcaacaacattgcgagccacatctctcccacaatggcttccaccaccagtttcccggcagaaacggtgccccaggcgcctgaagatcccctctttggcctggcccgcgcctacaaggctgacaacagcccgctaaaggtcgacctggtatgtcgcaagctgcttgttgctgataatgtttttatttcatctggattcacatccaaccccttttgtccttgctgtccttatcctcccaaacccttcccgtcgcagccgtgacaagactctggcgcaatcctttacgattgcgacgtcggagccggcgaacccacaaatatcccatcgcttgactaatagctaccgtgtctaatgcactctatgactgatgatattcttacttacagggaatcggcgcctaccgagataacaatgcgaagccatgggttcttcctgtggtaa

SEQ ID NO: 1332 - DNA, 467 bp, Artificial
  Synthetic
atatcagacacccgagagagtcaagtatgtcggccaagcccacgaccaagcagttcgggaagtcgacccgggaggttcccgcctccgcggaccaggcgaagaagtggtaccctgccgacgacgagagcgccccgaagaaggttcgcaagtccgtccgaacttgggccccccgaaagaccctccagcctggtaccgtcctgatcctcctcgctggccgcttccgcggcaagcgtgtcgtcctcctcaagactcttgaccagggtgttctcctcgtcactggtcccttcaagatcaacggcgttcccctgcgaagagtcaacgcccgatacgtcatcgccacctcctacaaggtcgacatctccggccttgacgccgccaagattgaggagatctctcagcccacgtacttcaccgccgagaaggccaaggagaaggcttccgctgaggctttcttcaagcagggagag

SEQ ID NO: 1333 - DNA, 172 bp, Artificial; identical to SEQ ID NO: 1160
  Synthetic

SEQ ID NO: 1334 - DNA, 325 bp, Artificial
  Synthetic
tcgaccgacgctcggcaacaatggcgacaattgcaagcggcttgcggcatgcgagatgcgcaagctcgattgctgcagctcaatggcggccggcaatcttcccgcggtcgaactttcaactcgccatccggtctataaccagcgactctcaaaagcctcccagtcttgaacttgaagccgccgagtccgtcccgatcccataccagggcgttacgcatgcgcgagttgttccggcgacaccatcttatttctcaagagaaccccagttcaacgattgatacattggaatctccaatctgctcaccaagtacaaccacctgcccac

SEQ ID NO: 1335 - DNA, 484 bp, Artificial
  Synthetic
aatctaccaacatcacaagcggttcaccatgttgagcttcctcggaaaatcggtagccttgctggctgcgctgcaggctactctcagctctgcaagccccctagccacagaagagcgctctgttgagaagagagccaacggatacgcaaactccgtctatttcaccaactggggcatttacgaccgcaacttccagcctgccgatttggtggcatcagatgtcactcatgtcatctactcattcatgaacctccaggcagacggcacagttgtctctggcgatacctacgctgatttcgagaagcactatgccgatgattcttggaatgatgtcggcaccaatgcctacggctgtgtcaagcagctgttcaaggtcaaaaaggccaaccgaggcctcaaggttctgctctccatcggtggctggacctggtccaccaacttcccctctgcagcaagcacggatgccaacccgaaagaactttgc

SEQ ID NO: 1336 - DNA, 452 bp, Artificial
  Synthetic
atctgatactcatcacctacactgaacgagaacaagactaattaattgacgtcgttaactcttccactttcaagaatgcatcttcaacacctaaacacactacaataatgtttttaggctgcttctcaaactggaccctaggaatgatccactaactactgttttcttcccgattcttgacaacgaacttacaccttcgattgccttgcatagaacgggcattttacctgccgaggaggatgttattccgcttaggcatctatctttgagtcccatgaatctcccgtgggttttcttgttaacgtcagacctgtagtagacatctaacaagtcctagcagttgttgaaggttacgtacaaccaatcactagccgagctggaaccaggacaactagcgccgggtttgactcaggtggttctcacgtccttacagtaggatgaaaccaagtagt

SEQ ID NO: 1337 - DNA, 623 bp, Artificial
  Synthetic
gaattcgggcttggcagaatcagcggggaaagaagaccctgttgagcttgactctagtccgactttgtgaaatgacttgagaggtgtaggataagtgggagccgtctttggcggcgaaggtgaaataccactacttttaacgttattttacttattccgtgaggcggaagcggggcatcgcccctctttttagatccaaggctagcttgctatgccgatccgggcggaagacattgtcaggtggggagtttggctggggcagcacgtggaatcccgtgtgaatcagcaaggaccaccttgcaaggctaaatactcctgggtgaccgatagcgaagtagtaccgtgagggaagggtgaaaagaacccccatcggggagtgaaatagaacatgaaaccgtaagctcccaagcagtgggaggagcctgggctctgaccgcgtgcctgttgaagaatgagccggcgactcataggcagtggcttggttaagggaacccaccggagccgtagcgaaagcgagtcttcatagggcaattgtcactgcttatggacccgaacctgggtgatctatccatgaccaggatgaagcttgggtgaaactaagtggaggtccgaaccgactgatg

SEQ ID NO: 1338 - DNA, 582 bp, Artificial
  Synthetic
gaattcaactaccatcttcagttatctttcattttcaatacaaaagatacataagaatggcaaccatggctctctcttctccatcatttgcaggcaaagctgtgactctaaaccctcaaacagaattcccaaccaatgtaagatctggcagcaacagcaagatctcgatgaggaagacatccgcaaagaagcctgccgcttcttcaggaagtccatggtatggtccagaccgtgtcaagtacctcggtcccttctctggtgagtctccatcctacttaactggtgaattcgctggtgactatggttgggacactgctggactatcagctgatccagagacctttgccaagaaccgcgaacttgaggtgatccattcaaggtgggcgatgcttggcgctttgggctgtgtcttccctgaactcctctcgagaaatggagtcaaattcggcgaagcagtttggttcaaagccggctctcagatattcagtgaaggaggacttgactatttgggaaattccagcttggttcatgcacagagcatcctagctatttgggccactcaagtcatccttatgggcgccg

SEQ ID NO: 1339 - DNA, 427 bp, Artificial
  Synthetic
gaattcagggaggaatggcgtagtatcggcgagcgaaatgcttcggggagttgaaaataagcatagatccggagagcccgaataggtcaacctttcgaactggtgctgaatccatgggcaggcaataggcaacctggcgaactgaaacatcttattagccagaggaaaagaaagcaaaagcgattcccgcgtgcctgttgaagaatgatccggcgactcataggcagtggcttggttaagggaacccaccggagccgtagcgaaagcgagtcttcatagggcaattgtcactgcttatggacccgaacctgggtgatctatccatgaccaggatgaagcttgggtgaaactaagtggaggtccgaaacgactgatgttgaagaatcagcggatgacttgtggttacgggtgaaatgccactcgaacc

SEQ ID NO: 1340 - DNA, 551 bp, Artificial
  Synthetic
gaattcaggaagcactagaaaaagagagtcatggccacctctgccattcaaaggtctgcattcgctggtcaaagtgctttgaagcaacaaaatgagttcatccgcaaagttggcaatgtggaaggtggtcgtatctccatgcgccgcactgtaaaaagcattcagtcaagcatgtggtatggaccagacagacctaagtacttgggaccattctcagaacagaccccatcttacctcactggtgaatttccaggtgactacggttgggacacagccgggttatctgctgacccagagacatttgcaaagaaccgtgaactcgaagtgatccactgcaggtgggttaatgttgggtgccctaggatgtgtcttccctgaggttctctcaaagaacggtatcaactttggcgaggcagtatggttcaaagctggatcacagatcttctctgagggaggtttggactaccttggaaaccctaacttggtacatgcccaaagcattcttgcaatctgggctactcaggttgtgctaatggggtttgttgagggat

SEQ ID NO: 1341 - DNA, 620 bp, Artificial
  Synthetic
gaattcacaacaaagaagcactagaaaaagagagtcatggccacctctaccattcaaaggtctgcattcgctggtcaaactgctttgaagcaacaaaatgagttcatccgcaaagttggcaatgtggaaggtggtcgtatctccatgcgccgcactgtaaaaagcattcagtcaagcatgtggtatggaccagacagacctaagtacttgggaccattctcagaacagaccccatcttacctcactggtgaatttccaggtgactacggttgggacacagccgggttatctgctgacccagagacatttgcaaagaaccgtgaactcgaagtgatccactgcaggtgggctatgttgggtgccctaggatgtgtcttccctgaggttctctcaaagaacggtatcaactttggcgaggcagtatggttcaaagctggatcacagatcttctctgagggaggtttggactaccttggaaaccctaacttggtacatgcccaaagcattcttgcaatctgggctactcaggttgtgctaatggggtttgttgagggatacagagttggtggtggtccacttggagaaggactagacaaactttaccccggtggatcttttga

SEQ ID NO: 1342 - DNA, 532 bp, Artificial
  Synthetic
  misc_feature (217)..(217): The residue at this position can be any nucleotide.
gaattccgagtccctgataattgaataaaccaagattttaccatgactgcaattttagagagacgcgaaagtgagagcctatggggtcgcttctgtaactggataaccagcacagaaaaccggctttatattgggtggtttggtgtgttgatgatccctaccttatggaccgcaacttctgtatttattatcgccttcattgctgctcctccagtanatattgatggtattcgtgaacctgtttctgggtctctactttatggaaacaatatcatctctggtgccatgattcctacttctgcagctatcgggttgcatttttacccgatctggttcgaagcacaatgtcgaaactagtaaggtggctttggatttcagagcagacaacaaacggaagctgaaccctggttcttcaagcggtaaactggcattcatcttgaagcagaaatcgaaacttgttgccactccagttaaattaggtgcagacgaggatgaagaagagggggatagaggaaatgatgtaaatgataat

SEQ ID NO: 1343 - DNA, 540 bp, Artificial
  Synthetic
gaattcgggactacccgctgaatttaagcattgcgatggtccctgcggatgctaacgcaatgtgatttctgcccagggctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcagaatcagcggggaaagaagaccctgttgagcttgactctagtccgactttgtgaaatgacttgagaggtgtaggataagtgggagccgtctttggcggcgaaggtgaaataccactacttttaacgttattttacttattccgtgaggcggaagcggggcatcgcccctctttttagatccaaggctagcttgctatgccgatccgggcagtggaggaggtaagccatctgattacttaccagaaggtttcttgaatagaactgtggaggtgggattag

SEQ ID NO: 1344 - DNA, 740 bp, Artificial
  Synthetic
  misc_feature (574)..(574): The residue at this position can be any nucleotide.
aacaaagcattgcggtggtccctgcggatgctaacgcaatgtgatttctgcccagtgctctgaatgtcaaagtgaaaaaatggaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcagaatcagcggggaaagaagaccctgttgagcttgactctagtccgactttgtgaaatgacttgagaggtgtaggataagtgggagccgtctttggcggcgaaggtgaaataccactacttttaacgttattttacttattccgtgaggcggaagcggggcatcgcccctctttttagatccaaggctagcttgctatgccgatccgggcggaagacattgtcaggtggggagtttggctggggcggcacatctgttaaaagataacgcaggtgtcctaagatgagctcaacgagaacagaaatctcgtgtggaacaaaagggtaaaagctcgtntgattctgatttccagtacgaatacgaaccgtgaaagcgtggcctatcgatccgataaatccttaacaaattagtattcgctatttgtgagggccgttctagctatatcccaaatcgttgattaataataagataagtcaattacttcgagaactccatagatttt

SEQ ID NO: 1345 - DNA, 709 bp, Artificial
  Synthetic
gaattcagaagagacttgaagaaaaacaatggcaacccagactttggtttcatcttctcttacttcatcttcttcttcttcaatggaagctgctagacaagtattcagaggaagaccacttcaatatgcaactgttaacgttggctcttcaaggaagggttcatttgttgttagagctgctgccactccacctgttaagcaaggagcaaacagacagctttggtttgcatccaaacagagtctttcttacttagacggcagtctcccaggtgatttcgggtttggcccacttggcctttcagatccagaaggaacaggaggatttattgaaccaaaatggctagcatatggtgaaattatcaacggacgttttgccatgttaggagcagcaggagcaatcgcacccgaagtcttcggcaaactcggtcttatcccagctgaaaccgcactcccatggttccaaactggagtgattccacctgccggaacttacagttactgggcagaccccttcacactatttgtactagaaatggctcttatgggttttgctgagcacaggagattgcaggactggtacaaccctggatccatgggcaaacaatatgtcttaggtttggaaaagggtttgggtggatcaggtaaccctgcttacccaggtggacctttctttaacccactaggatttggaaaagatgagaagtcaatg

SEQ ID NO: 1346 - DNA, 681 bp, Artificial
  Synthetic
tgtctctcttctacagtcccaaaaacattgatctgatctgagggaatcaaaggttgttgctggaactctttaacaagagagaatttgagatatgggtcgtggagtcagctatggaggagggcaaagttcactgggatacttatttgggggtggtgaagcgccaaaatcaaccacggaaaatgtccaagctgttcaaagtgaaggacaggcaataaataaagagccagcttcaaagcctgctgtttctgctccagttgatgctactaagcagattcctgccggtattcagagcacccattcatttaaccatttcaggagagatggtcaaaacacaggaaattttatcacggaccgaccatctaccaaagtccatgctgctcctggaggtggatcttctttgggatatctcttcggcgatggcagcagctaagcaattctccaacctacagttggataattgtcttatcgcttctttaccttttgcttttcgactatgttgtaattctaattgcgagtatttcaggtcgttgtgaagtgttaattggataaactttcgtctaaagtcccagttgacacttgaaactaaagttactactatctgatgtaatttgttacttttgttgattgatcatttgattgaacagcttttgttgcctaaatttcatatgttcttgattttat

SEQ ID NO: 1347 - DNA, 719 bp, Artificial
  Synthetic
tggtatgaacgcagagtggccattcgccgggggcccacattacagagaaattcaattctttcaagcacaaagcaaagattgttgttttacagtaacaaaatagtattaatggctggtagaggaaaaaccctaggttccggtgctgcaaagaaagctacgtcccgtagcagcaaagccggtctccaattccccgttggtcgtatcgcccgtttcctcaaagccggcaagtatgccgagcgtgtcggcgccggcgctcccgtttaccttgctgccgtccttgagtaccttgcagctgaggtacttgaattggctggaaatgcggcgagggataacaagaagacgaggattgtaccaaggcatattcagttggctgtgagaaacgatgaggaattgagcaagttgcttggagatgtgacaattgctaatggtggtgttatgcccaacattcacaaccttttgctgcctaagaagactggtggatcctcaaagccctctgctgatgaggattaaatagatggccaatttggaattgagagctatatgatgtttttgttagtctatagagagatttagatcatgaaattaagcccccacccccaaatgtggaatgttatttccttagttctgctagttgtcaaggtttatgttagtatgtgaatacaaattaagggatgtatgaaaacatctttttttgatttttgaattctatctgttccagt

SEQ ID NO: 1348 - DNA, 524 bp, Artificial
  Synthetic
tcgaaatctcatctctctgtaaaacaaaatccatttaattcctgtgtttaacagtaacaacaatcaaatggcaggtagaggaaaaaccctaggatctggagcagcaaagaaggctacatcccgtagtagcaaagccggtcttcaattccccgtcggtcgtatcgcccgttttctcaaagccgggaaatatgctgagcgagttggtgccggtgcccctgtttaccttgctgccgtcctcgaataccttgctgctgaggtgcttgaattggctggaaatgctgcgagggacaacaagaagactaggatagtaccaaggcatatacagttggcagtcagaaatgacgaggaattgagcaagttgcttggagatgtcactattgccaatggcggtgttatgcccaatattcataaccttttgctgcctaagaaagctggtggctcctcaaagccctctgctgatgaggattagattggaaggacaatagggagtttcaagtgttaagccttaaatttggtttttgact

SEQ ID NO: 1349 - DNA, 554 bp, Artificial
  Synthetic
tctccctctctcatctgcgcatctcttgtcggagaagctaactctctaaccctagctatggccgctggagggggaggtcgtggcaagcctgccggaaagaagtccgtctctcgtagcaacaaggcgggcctgcagtttcctgttggtcgaattgcccgcttcctgaaggctgggaagtatgcagagagagttggggcgggggcccctgtctaccttgcagctgtccttgagtacctcactgcggaagtcctggagcttgctgggaatgctgcgcgggacaacaagaagaacaggatagtcccccgccacatccagcttgctgtgaggaatgatgaggagcttagcaagctccttggccaggtcactattgccaatggaggtgtcctccccaatatccataatgtcctccttcccaagaaagcaggatcgagctccaaggtggcggcagcagattctgaagcctgaaaagggggaaaaaaaaagaagacttactgaagaaacttggtgtttgttgacaccactgatgctctgtgaagatttaggctctgagaatg

SEQ ID NO: 1350 - DNA, 365 bp, Artificial
  Synthetic
tggtatcaacgcagagtggccatcggccggggactcaacactcaaattacaatccaaaagcttatattttttctgttacttctctgtactcaagctttgttaacagttcgttcacaacaatggaagcagcaaccaagacgaccaaaggtgccggaggaaggaaaggcggaggcccaagaaagaaggctgtaaccaaatctgtcaaggctggtcttcagttcccagttggtcgtattgctcgtttcctgaagaagggtcgttatgctcagcgtgttggaagtggtgctccaatttacctcgctgctgttcttgaataccttgctgctgaggtgttggagttggctggaaatgcagcgagagataat

SEQ ID NO: 1351 - DNA, 688 bp, Artificial
  Synthetic
ccgaaatatcatatcatgcgctaattaaacatacttaggcaaaagccaaatatacttagctttaaaacctaatttgatccccaaaaaacaccatcagggtctattttacaagttccgaatccaaacaagagaactgaactaagaagtctaagaacctcagaactcctgagaagcagatccaatatctcctttgttcttgccaaccttggatggcaaaagagtctgatgaatatttggcaaaactcctccattcgcaatcgtcacacttcccagaagtttgcttaactcttcatcgttcctcactgcaagctgaatgtgtcttggtactatacgtgtcttcttgttatcccttgctgcgtttcccgccagctccaacacctcggcggcgaggtactcgagaacagcggagagatagaccggagctccggcaccgacacgctcggcgtatttaccggatttgaggaatctagcgattcttccgacggggaattgaagaccggctttagatgatcgagagacggatttggtggcctttggctttcctctgccacctttggttgttccgcttcctgcgcctgtactcatcgtcttcttcgaaatttagaacagataaacgatttgatgagagtttgaagaaatcgaagagaaatgactattgtagatgatctccgaattgcggacgcgtggg

SEQ ID NO: 1352 - DNA, 624 bp, Artificial
  Synthetic
ccctcgaccacgcgtccgcaagcagcagttgattatctcagctgactttcccacaaatcgagagttagggttagggttttgtgtttcatctgaaaatgagttctgatggaggatcgggtaagggcaagggtggcgcaggtagaggaaaacctaaggcatcaaaatcggtgtctcggtcttcaaaagcggggctacaattccccgttggtaggatcgctcgtttccttaaggctggaaagtatgctgaacgtgttggtgctggtgcgccagtttacctatctgctgtccttgaatacctagcagctgaggtgttagagttggcagggaatgcagcaagggataacaagaagaatcgtattgtgccgaggcacattcagttggctgtgaggaatgatgaggagctgagcaagcttttgggtcaagttactattgccaatggaggtgttttgcccaacattcaccagaatcttttgcctaagaaagctggctctgggaagggtgatattggctctgcatcccaggagttttagatgtaaaaatgaagcttttgttttcctaaaggattaggggaaatgagtagacttcctttatgtaatatataaaaataccctttctagtttgtta

SEQ ID NO: 1353 - DNA, 693 bp, Artificial
  Synthetic
gccattacggccggggataccgggaaaacaattcaaatttgaacacgtcaacatgccttcaacaacagcaaccaaatcggtgggtggtagaggaaaactccaaaaagctacaaaatccatctccagatctcaaaaggcgggtctccaattccctgttggccgagttgctcggtttttgaaaaagggtcgttatgctcagcgagttggctccggttcaccggtttatctctcagcggttcttgagtaccttactgctgagttgttggaacttgctgggaatgctgcaagagacaacaagaagaacagaattgttcctaggcatatacagcttgctgtgaggaacgatgaggaattgagcaagttgttggggtctgcaacaattgctaatggtggggttctgcccaatattcaccagaatttgcttcctaagaagattggcaaagggaaacctgaagtgggttccgcttcacaggaattttagatctttaggtgtagtattaagggattgggtagtgaaattttatttgttcataatggttcaaacgtggggatgtagctcaaatggtggagcgctcgctttgcatgcaagaggcacgggcggggttcgatcccccgcatctccatatttttaggtttctgcaatttcgtttttcctcagcatttttctcgaagcaaagtcgtctttacaccaac

SEQ ID NO: 1354 - DNA, 565 bp, Artificial
  Synthetic
acttttatttccactcctcactaacacttttatctaacaacaacaacaacacacaatgtcttccggtggaaagtccggtggcaaggccgcctcctcttctaagacctccaagtctcgatccgctaaggccgatcttaccttccccgttggtcgagtccaccgactcctgcgaaagggaaactacgcccagcgaattggtgctggtgcccccatctacctcgctgccgtccttgagtacctcgccgtcgagattctcgagctgtccggtaacgctgcccgagacaacaagaagagtcgtatcgttccccgacatctgcagctcgccatccgaaacgatgaggagctgaacaagctgcttggccacgtcaccattgctcagggtggtgttctccccaacatccaccagaaccttctgccccgaaagtccgccaagggcgccaagggtgcttctcaggagctctaagtctcttgaaggctttatattttatctattgggttaagggttgttttaatgtccattaaaactgtttacagtgtactataatgaatgacatgtattgtattt

SEQ ID NO: 1355 - DNA, 678 bp, Artificial
  Synthetic
cactatccacgctgcacgtttaccattccgacatttgccgcatctcgcaccttacatctactttcgagtaatttttcgttaacccaaaaaccaacttcaaaatgactggcggcggcaaatctggcggcaaggcctctggctccaagaacgctcaatcccgatcctccaaggcgggtcttgcgttccccgttggtcgtgtccaccgtcttctccgaaagggcaactacgctcagcgtgtcggtgccggtgctcccgtctacctcgctgccgttctcgagtacctcgctgccgaaatcctcgagttggctggtaacgccgctcgtgacaacaagaagacccgtatcatccctcgtcacctccagctcgccatccgaaacgatgaggagttgaacaagctgctgggacacgtcaccatcgctcagggtggtgttctgcccaacatccaccagaacctcctccccaagaagacgactggcaagactggcaagggttccagccaagaattgtaattttttcgttggtcgtttgcgctttctttcgaggtcgttttggttgtcataaaggggtcaagggataaggtttacggttgcttttgtacgtctgggttgtacattaatcccccacggctatgatcatgaatcaattagggtttttttcaaatgcacttcattaaaacgt

SEQ ID NO: 1356 - DNA, 726 bp, Artificial
  Synthetic
cccacgcgtccgcggacgcgtgggaaaaaaatcctcctcgccttcgacagcagcagcaaccagcttagctaggctagccatggacgccgccggagccggagcgggtgggaagttgaagaagggagccgccgggaggaaggccggtgggccgaggaagaaggcggtgtcgcgctccgtcaaggccgggctccagttccccgtcggccgtatcggccgctacctcaagaagggccgctacgcccagcgcatcggcaccggcgcccccgtctacctcgccgccgtcctcgagtacctcgccgccgaggtgctggagctcgccgggaacgcggccagggacaacaagaagaacaggatcatcccgcgccacgtgctgctggcgatcaggaacgacgaggagctcggcaagctgctggccggcgtgaccatcgcgcacggaggcgtgctgcccaacatcaacccggtgctgctgcccaagaagacggcggagaaggccgccgccgccggcaaggaggccaagtcgcccaagaaggccgccgggaagtcccccaagaaggcctaggcgtcggcgcctcgctttgcttgtttagctggagtagattggacgggatgtgtgtctgttagtagtctaatgctgttgatttaatctatggtggtgtcgttgaaccttgtgatctgtgcttgtgtctgttcaagaagataaatttaagagatgttaaatttttcttc

SEQ ID NO: 1357 - DNA, 655 bp, Artificial
  Synthetic
caacaatcaactataatatcaattctttttcaccaatcacaactttgctctttctcatttccaaatggatactgccgggaaagcaaaaaagggtgccggcggcagaaaggctggtggccaatcgaagaagccggtttctcggtccgtcaaagccggtcttcaattcccggtcggtagaattggtcgttatctgaagaagggtcgttacgctcaacgcgttggaagtggtgctccggtttatttggctgctgttcttgagtatttggccgctgaagtgttggaattggctggaaatgcagcgcgtgacaacaagaagaacagaattattccaaggcatgttctgttggctgtgaggaacgatgaagagctagggaagcttcttgctggtgtgacaattgctcatggtggtgtgcttccaaatatcaacccgattttgttgcctaagaaaactggcggagctgaaaaggaaccgaaatctcctgctaaggccacaaaatctcccaggaaagctgtagcttagaccttttaagtgactgctgaaactcaaacttcttttggtttgtttttcttttgtatgtaattgtaatttttgaactttgtgcccgtgccagttgttcttcatagtcaaatcattgaaaccccttgtttctaaaaa

SEQ ID NO: 1358 - DNA, 347 bp, Artificial
  Synthetic
tggtatcaacgcagagtggccattacggccgggggaaatgtccaggtagctaaaattgaaactgagaaaatgcttattcaaatggttgaaactgaattaggtcagaggaagcagaagggtggatataatgctcaatttaaaggacaatcccactttttcggttatgaaggaaggtgtggcttgccatccaattttgattccacatactgttacgcgttgggatacggtgcaggagcactgctgcaaagtgggaagacagggctgatatcatcggttggcaacttggctgctccagttgaagaatggaccgttggtggaacagcactcactgcattgatggacgtgga

SEQ ID NO: 1359 - DNA, 727 bp, Artificial
  Synthetic
caaggtccctgatgctcagataattactgaacatcctgtaggtagggttggggtgctattttgtggtagacaatctcctggaggacacaatgtgctatggggtcttcatgatgctcttaaggttcacaaccccaataataccttgcttgggtttttgggtggttctgaaggtttatttgcgcagaaaactctagagatcaccactgacgttcttgctacatataagaatcaaggtggatatgacatgctgggacggacaaaagatcaaattagaacgactgagcaagtaaatgctgcaatggctgcatgcaaagctttgaaattggatggccttgtcattattggaggagtgacatcaaatactgatgctgctcagctggcagaaaaatttgcagaagcaaaatgccctacaaaagtggttggtgttcctgttacattaaatggggatctcaagaatcagtttgttgaagcaaatgttggctttgacacaatatgcaaggttaactcccaactcattagcaatatgtgcactgatgcactctcagcagagaagtattactatttcatcagactcatggggcgaaaggcatcacatgttgccttagaatgcactctgcagtcgcatcctaatatggtgattcttggggaggaggtagctgcgtcaaagctaaccctctttgacatcacaaaacaaatttgtgatgcagttcaggctagggctgaacat

SEQ ID NO: 1360 - DNA, 431 bp, Artificial
  Synthetic
acgcgtcggatttgacactgtttgcaaggtcaactcccagctcatcagtaacataagcacggacgcactgtcagctgagaagtattactacttcatcaggttgatgggacggcgagcatctcatgtatcactggaatgcgcattgcaatcgcatccgaacatggttatccttggagaggaagttgcgacgtctaaaatgactctctttgatgtcacaaagcaaatctgcgatgctattcaatcgagggcgcagcaagagaagtatcatggagttatccttcttccggaaggccttatagagagcattcctgaagtctatgcacttttgcaaaatccacggtctccaaaagcaagatgttgagatcgagcacattccagcacgtctgtccccctgggcgtcggctcttctacgaatttctgcccccatttat

SEQ ID NO: 1361 - DNA, 590 bp, Artificial
  Synthetic
atggcgctgatacttatccccgagggcttgattgatttcattccagagattcacgcacttgatttcggagttgaatgagatcttggcgactggtacagtggatgaagagggacactggaggcacaagttatctgaacaatgccatgcgctcttcgactcattgccgcatagtatccaagaagagctgctcctggagcgggatccccatggaaacgttcaggttgccaaaattgaaaccgagaaaatgttgatctctatggtggagaccgaactttctcaaaggaagcacgaaggatcgtacaaatgggaacttcaaggggcagtctcactttctcggatatgaaggccggtgtggtcttccgacaaacttcgattcaacgtactgctatgcccttggctatgctgcgggagcgctccttcacgctggacaaacgggattgattgcctcggtgggaaacttgtcagctccttcaaaggactggactgtgggaggaacggcattgacagcattgatggatgttgagaggcgaagaggcaagaacaagccggttataaagaaagccatggttgaacttgatggtgcacctttc

SEQ ID NO: 1362 - DNA, 670 bp, Artificial
  Synthetic
cccggctcttagttttagttaaattcaactggaaattttctctgtgggttttgctcaaaacaaagctgagactctctgattttgacttttaagaatggcaagtcctatggagaaggagagtcataacgtaattaatgatgaaattgtgtcggtggagcttcctgcacctccttcctggaaaaagttgttcattccaaagcaagggagtacaccaaagaggaatgaggttgtatttattgctccaactggagaggagttcaagaaccgcaaacagttggagcagtatctcaaatcacaccctggtaaccctgcaatatcagaatttgattggagtaccggcgagactccaaggagatcaacaaggatcagtgagaaggcaaaggcaatgagaccacaatcactacttgaatcaccaatgaaaagacgccgaacatcatctggtgtaaagaaagatagcaaggaagcggaagctgcaaaagttgaccaggaaagttctgaaacgaaagagatggaatctgccaaagaagaaaatgagaacttggagaagaaagatggaggagcagaagctgaaatgaacaaggggaagaaagaggtggaagctgcggatgaagaggcagagggcatgaagggtgctgaactacacccggaggagaagccagaaatggatgac

SEQ ID NO: 1363 - DNA, 1073 bp, Artificial
  Syntheticv
tggtatgaacgcagagtggccattacggccggggacagctattttctctattacttcagccatcaaaaaacacttatttctccttattaaaccatggctgcttctacaatggctctctcttcctcttcttttgccggaaaggcagtaaaactattaccgtcttcctctgaaatcaccggaaatgggaaagttaccatgaggaagactgctagcaagcccaagcctgtctcttctggcagtccatggtatggccctgaccgtgtcaagtacttgggcccattctctggtgagtccccaagctacttgactggtgagttccctggtgactacgggtgggacactgctggactttcagctgatccagaaacttttgccaagaaccgtgagttggaggtgatccactgcagatgggcaatgcttggagctcttggttgtgtcttccccgagctcttggcccgtaacggtgtcaagtttggtgaggctgtatggttcaaggctggatcccaaatttttagcgagggtggacttgactacttgggtaacccaagtttggtccatgctcaaagcatcttggccatttgggcttgtcaagttgtgttgatgggagccgttgagggttatcgtgttgctggtggacctctcggtgaggttgttgacccactttaccccggtggtagcttcgacccattgggcctcgctgaagacccagaggcttttgctgagctcaaggtaaaggagatcaaaaatggtagacttgccatgttctccatgtttggattctttgttcaggctatcgtaactggaaagggcccattggagaaccttgccgatcaccttgcagacccagttaataacaacgcttgggcctacgcaacaaactttgtccctggaaagtgagttaacaaaagttgatctttaatctttaagtagtgtgagactgaacatgtagcttgtgagtgatgaacccaaagaagggtcagagtttatttttagcattctgggttatgggttcattaaagggattgtgtaaattggtttggattaattaatgaagaacatgtggatcttttcat

SEQ ID NO: 1364 - DNA, 914 bp, Artificial
  Synthetic
actcacacattgacaggcttgctagtaaattggtctgatcaaggaggcagagcccagccatggcttcggtgacagcagcgctttcttcctccctggccgggcaagtagtgttgaagccacagagcgagctagcagcgaaggtgggcaacaatgtgctgggcgaggcaaggattagcatgaggaaaactgcctccagagtgtcggtgccagacagcccatggtacggcccagagcgggtcaagtacctaggcccattctccggcgactctccctcatacttgaatggggagttccccggcgactacggctgggacactgccgggctctctgctgaccccgagacatttgcccgcaacagggagttggaggttatccactgccgctgggccatgttgggcgctctaggctgtgtcttccccgagctcctcgccaagaatggcgtcaagttcggagaagctgtctggttcaaggctgggtcccaaatctttgctgagggtggtcttgactacctaggtaaccctagccttgtccatgcccagtctatccttgccatctgggcttgccaggtcatccttatgggtgctgttgaaggctaccgtgttgctggtggtccccttggtgatgtgactgaccccatctaccctggtggaagctttgacccccttggcctagctgatgaccccgaggccttctctgagctcaaagtgaaggagattaaaaatggtcggttggctatgttctccatgttcggattcttcgtgcaggccatcgtgactggcaagggcccagtcgaaaacttggttgaccaccttgctgaccctgttaacaacaatgcctgggcattcgccaccaactttgtccccgggaattagagtgtagtctgctacttgtttgaatgatcttttcctataatg

SEQ ID NO: 1365 - DNA, 983 bp, Artificial
  Synthetic
agaaagaaagagagaatggcatcaatggcagcaaccggcagctccgccactgttgttagagcaactccattcttgggccagaccaaatatgccaaccctcttagagatgtagttcccatgggctctgccaaattcaccatgagtaatgatttgtggtatggacctgaccgtgtcaagtacttgggacccttttctgctcaaactccttcctacttgactggagaattccctggtgattacggatgggacacagccggtttatctgctgatcctgaggcctttgccaagaacagagctcttgaggtcatccatgggagatgggccatgcttggggcactgggttgcattactccagaagttctcgagaaatgggtgaaagtggacttcaaggaaccagtatggttcaaagctggagcccaaatcttcagtgaaggaggactcgactatttgggcaacccaaaccttgtccatgctcagagcattctagcagtgttgggcttccaagtagttctaatgggccttgtagaaggttttagaattaatgggcttcctggagttggtgatggcaacaatctctacccaggtggtcagtactttgacccacttggcctagctgatgacccaactacttttgccgagctcaaggttaaggagatcaagaatggaagattggctatgttctccatgtttggattctttgttcaagctattgtcactggcaaaggtcctcttgagaaccttttggatcaccttgacaaccctgttgctaacaatgcatgggtttatgcaactaagtttgttcctggatcttaaattttacattttgacttcctccacaagaggcttgtaccactgagtcattcagaatgcaaatatttggcagatgaaaactattttgccatgtgataaatactcttttagccactaacatttcattaactcttgtggtaaggactatgcctcaatcccaagcacccaagcaa

SEQ ID NO: 1366 - DNA, 755 bp, Artificial
  Synthetic
cggacgcgtgggaaaaaccaacccaaccgccgccgcatcgccctcgttagaacgatggccgcgtcggcgctgcaccagaccaccagcttcctcggcaccgcccctcgccgggatgagctcgtccgccgcgtcggcgactccggtggccgcatcaccatgcgccgcaccgtcaagagcgcgccccagagcatctggtatggacctgaccgtcccaagtacctgggcccgttctcggagcagacgccatcgtacctgaccggagagttcccgggagactacgggtgggacacggcggggctatcggccgacccggagacgttcgcgaggaacagggagctggaggtgatccactcgcggtgggcgatgctgggggcgctgggctgcgtcttcccggagatcctgtccaagaacggggtgaagttcggggaggcggtgtggttcaaggccggcgcgcagatcttctccgagggggggctcgactacctggggaaccccaacctggtgcacgcgcagagcatcctcgccatctgggcggtccaggtggtgctcatgggattcgtcgagggctaccgcgtcggcggcggcccgctcggcgagggcctcgacaaggtgtacccaggtggcgccttcgacccactcggcctcgccgacgaccctgacaccttcgccgagctcaaggtgaaggagctcaagaacggccgcctcgccatgttctccatgttcggcttcttcgtccaggccatcgtcaccggcaa

SEQ ID NO: 1367 - DNA, 966 bp, Artificial
  Synthetic
cgcggccaccatggcgctctcctccccggtgatggcccgcgcggcgccgtcgacctcctccgcgctcttcggcgaggcgcggatcaccatgcgcaagaccgccgcgaagcccaagccggcggcgtcgtcggggagcccgtggtacggcgccgaccgcgtcctctacctcggcccgctctccggcgagccgccgagctacctcaccggcgagttcccgggcgactacgggtgggacaccgcggggctctccgccgacccggagacgttcgccaagaaccgggagctggaggtgatccactcccggtgggcgatgctgggcgcgctcggttgcgtcttcccggagctcctcgcccggaacggcgtcaagttcggcgaggcggtgtggttcaaggcggggtcgcagatcttcagcgagggcgggctcgactacctcggcaacccgagcctgatccacgcgcagagcatcctcgccatctgggcggtccaggtggtgctcatgggcgccgtcgaggggtaccgcatcgccggcgggccgctcggcgaggtcgtcgacccgctctaccccggcggcagcttcgacccgctcggcctcgccgacgacccggaggccttcgcggagctcaaggtgaaggagatcaagaacggccgcctcgccatgttctccatgttcggcttcttcgtccaggccatcgtcaccggcaagggccccctcgagaacctcgccgaccacctcgccgaccccgtcaacaacaacgcctgggcctacgccaccaacttcgtccccggcaagtgagcgccgccgccgccgtgctgccatggcgacgcatcgccttcagctaagctagctaggttgacgacgatgcgcgtctctgcaggagagtgtgcgtgtgtgtacgcggtgcagtagatgtacgtacgtgtaccgtatagatgtacgtattcgtgtggaccgcgtggatggatgta

SEQ ID NO: 1368 - DNA, 363 bp, Artificial
  Synthetic
cccacgcgtccgacttggggaacccgagcttggtccacgctcagagcatcttaggcatttgggctactcaagttatcctcatgggagctgttgaaggctacagagtcgccggagatggtccattgggagaagcagaggacttgctttacccaggtggcagcttcgacccattgggcctcgctactgaccccgaggctttcgcagagttgaaggtgaaggagctcaagaacggaaggttggctatgttctctatgtttggattcttcgttcaagccatcgtcaccggaaagggacctttggagaacctcgccgaccatttggccgacccagtcaacaacaacgcttgggccttcgccaccaact

SEQ ID NO: 1369 - DNA, 651 bp, Artificial
  Synthetic
gaatccgaatgatttgtggtatggaccacacagagttaagtacttgggtccattctctgctcaaactccatcgtacctaaaaggagaatttcctggtgattatggatgggataccgctggattatctgctgatccagaggcctttgctaagaacagggctcttgaggttattcatggaagatgggctatgttgggagcactcggatgcataacccccgaagtactacagaaatgggttaaggtcgactttaaggaacccgtatggttcaaagctggttcacaaatcttctcacaaggcggtcttgactacttgggaaacccaaaccttgtccatgcccagagtatcttggctgttttaggtttccaagttctgcttatgggtcttgtcgaaggtttccgtattaacggattacacggagttggtgagggaaacaacttgtaccctggtggaacctacttcgacccattgggacttgctgatgaccctgttacctttgctgaattgaaggtgaaggaaattaagaatggacgtcttgctatgttttctatgtttggcttctttgttcaagccattgataccggaaaaggtcctcttgagaacctctttgatcaccttgacaaccctgttgctaacaatgcttgggtttacgc

SEQ ID NO: 1370 - DNA, 923 bp, Artificial
  Synthetic
gaattcgggcacagctgtagctttgaacgcacaggggaaattcccaaccaatgttagatccagtagcaatggaatgattgtgatgaggaagacatcagcaaagaagcctgctgcttcttcaggaagcccatggtacggtccagaccgtgtcaagtaccttggacccttctctggtgagtctccatcttacctaactggtgagttccctggtgattacggctgggatactgctggactatctgcagacccagagacctttgccaagaacagggaattggaagtgattcattccaggtgggctatgcttggcgctttgggatgtgttttccctgaacttctctctagaaatggagttaattttggagaagcagtctggttcaaagctggttctcagattttcagtgaaggtggacttgactacttgggaaactccagcctggttcatgcacagagcatcttagctatttgggcaacccaagttatccttatgggagctgttgagggatacagagttgccggtggtccactaggtgagatcgtcgacccactttacccaggtggtagctttgaccccttaggacttgcagaggacccagaggcatttgctgagctgaaggtaaaggaacttaagaacgggagacttgctatgttctccatgttcggattcttcgttcaggctattgttaccggcaaaggtcctttagagaatctggcagatcacctgtctgaccctgtgaacaacaatgcttggtcatatgctaccaattttgctccaggaaagtgagaatgtacatgatagtcaactaagatgatttcatttccttcaaaaggcgaaggagatggcttttcttatctttcaacttttgtacatacatccatttagcttgtaaaacaatctggcattcggattaatttgtacttaa

SEQ ID NO: 1371 - DNA, 694 bp, Artificial
  Synthetic
gaattcaatggctgcttcaacaatggctctctcttctccttctcttgctggaaaggcagtgaagctaactccatccattccagaaggcgaaggaagaattaccatgctcttccagaaaaagacaccggcaaaagcagctaaatcatccaaacccgcagtttcatctaacagcccatggtatggtcctgacagagttaagtacttgggacctttctccggtgaggcaccatcatatctcaatggtgaatttcctggtgactatggttgggataccgctgggttatctgctgatcctgaaactttcgccaagaaccgtgagcttgaagtgatccattgcagatgggctatgctcggagctctaggatgcatcttccctgaattgctctcgcgcaatggagttaaattcggtgaagccgtttggttcaaagccggagcacagattttcagcgagggaggattggactacttaggtaactcaagcttagtacatgctcaaagcattttagctatttgggcgacacaagttatcctgatgggtgcagtggaaggttaccgtgtcgccggtggacctcttggtgagattgtcgacccactgtaccccggtggcagcttcgaccctcttggacttgctgatgacccagaggcttttgctgaatggaaggtgaaggagattaagaacggaagattggcgatg

SEQ ID NO: 1372 - DNA, 768 bp, Artificial
  Synthetic
tggtatcaacgcagagtggccattacggccggggccctttctctggtgagtctccaagctacttgactggtgagtttcctggtgactacggatgggacactgccggactttcagctgatccagaaacttttgccaagaaccgtgagttggaggtgatccactgcagatgggccatgcttggagctcttggatgtgtcttccccgaactcttggcccgtaacggtgtcaagttcggtgaggctgtatggttcaaggctggatcccaaattttcagcgagggtggacttgactacttgggcaacccaagtttggtccatgcacaaagcatcttggccatttgggcttgccaagttgtattgatgggagccgttgagggttaccgtgttgctggtgggcctcttggggaggttgttgatccactttaccccggtggcagcttcgacccattgggcctcgctgaagacccagaagcttttgctgagctcaaggtaaaagagatcaagaatggtagacttgccatgttttctatgtttggattctttgttcaggctatcgtaactggaaagggtccattggagaaccttgccgatcaccttgcagatccagtaaacaacaatgcttgggcctacgctacaaactttgtccccggaaagtgatttaacaaaagttcataatctctaatcttcaagtagctagtgtttgatatgtagcttgtgagtgatgaacccaaagaagggtcaggtttattttgagcattctgggttatgg

SEQ ID NO: 1373 - DNA, 944 bp, Artificial
  Synthetic
ctaagcatcagcacaaataagattaaaaatcttacaaatggctacttctgcaattcaacaatctgcatttgctggacagacagctcttaagtcacagaatgagctcgttaggaagattggtagctttaatggtggacgtgccactatgcgacgtacggttaaaagtgccccacaaagcatttggtatggagaagacagaccaaagtacttgggaccattctccgagcaaactccttcttacttgactggtgagtttccgggtgattatgggtgggataccgcgggactttcagctgaccctgaaacattcgccaggaaccgtgagcttgaggtgatccattgccgttgggccatgcttggtgctttgggttgtgtcttccctgaaatcctttccaagaatggtgttaaatttggtgaggcagtttggttcaaggctggatcccaaatcttctcagaaggcggtcttgactaccttggtaacccaaaccttattcatgcacaaagcattcttgctatttgggcatcccaagttgtgctcatgggcttaattgaaggatacagagttggcggaggcccactgggtgaaggtcttgacaagatctatccgggaggagcttttgacccactagggctcgctgatgatcccgaggcattcgctgagttgaaggtgaaggaaatcaagaacggccgattggctatgttctcaatgtttggatttttcgttcaagccattgtcacaggaaagggaccaattgaaaacctttacgatcatattgctgaccctgttgccaacaacgcatgggcttttgccactaactttgtacccggaaaatgaaatgaatagcctgtaatatgtaaaatttgtggagctagttgtttcatattcttgatgtgatatgaacttgctaatatatatgcaaaagccaatatcccataaaaaaaaa

SEQ ID NO: 1374 - DNA, 722 bp, Artificial
  Synthetic
tattgttcaactcatcaagaggtagcaactgcaatggctttctcttcctccctggccggtcaagtagtgttgaagccacagagcgagctagcagcgaaggtgggcaacaatgtattgggcgaggcaagagttagcatgaggaaaactgcctctagagtttcggtgccagacagcccatggtatggcccagaacgggtcaagtacctaggcccattctccggtgactcaccctcatacctgaccggggagtaccctggcgactatggctgggatactgctggcctttctgctgaccccgagacctttgcccgcaacagggagctagaggtcatccactgccgatgggccatgttgggcgcactgggctgtgtcttccccgagctcctctcaaagaacggtgtcaagtttggcgaagctgtctggttcaaggctgggtctcagatctttgccgagggtgggcttgactacctgggtaaccctagcctggtccatgcccagtctatccttgccatctgggcttgccaggtcatcttgatgggtgctgttgaaggctaccgtgttgctggtgggccccttggcgatgtaactgaccccatctaccctggtggcagcttcgaccccctagggctagctgatgaccccgaggccttctctgagctgaaagtgaaggagataaagaatggacggctggctatgttctccatgtttggattcttcgtgca

SEQ ID NO: 1375 - DNA, 394 bp, Artificial
  Syntheticv
cccacgcgtccgggcaggctctcagattttctcagaaggaggtcttgattacctcggaaaccctaacttgatccacgcgcaaagcatcttagccatctgggctgttcaagttgtgctcatggggttcattgaaggctacagaatcggaggtggaccactcggagaaggacttgacccgctttatcccggaggtgcgttcgacccattgaacttggctgaggatccagaggctttctctgagctgaaggtgaaggagctcaagaacggtcgtcttgccatgttctctatgtttggattctttgtccaagccattgttactggtaaaggtcccattgagaacttatttgatcatttggctgatcctgtggctaacaacgcctggtcttacgctact

SEQ ID NO: 1376 - DNA, 692 bp, Artificial
  Synthetic
gtcaagggaagaagaggaggaaggtcttggctatggcttccgcagtgtgtgcatcgctcacctcgtccttggtcggtcagattgagcttaaacctcagaatgagctctcaaggaaggtttcccatggcgaagctaaagttactatgaggagaactgtcaagactgcccctgagagtatctggtatgggtcggatcgtcccaagttcttgggtccattttcagagagcacaccgtcatatttgacaggcgagtttccaggcgattatgggtgggacacagcagggctatcagcagatccggaaacatttgcccggaaccgcgagttggaggtgatccactcacgctgggcaatgttgggggccttgggttgcgtaaccccggagctactcgcaaagaatggggtgaagtttggcgaggcggtgtggtttaaggcgggctcgcaaatcttctccgaggggggccttgactaccttggaaaccccaacttgatccacgcccagagcatcctcgccatctgggcttgccaggtggtcctcatgggtgctgtagaaggctacagggttggtggtggccccctcggtgaaggtttggacccaatctaccccggaggtgcctttgacccacttggtcttgccgatgaccccgactcctttgctgaattgaaggtgaaggagttaaagaatgggagattg

SEQ ID NO: 1377 - DNA, 484 bp, Artificial
  Synthetic
aggagggtggactcgactacctgggcaaccccagcctgatccacgcccaatccattctcgccatctgggcctgccaggtcatcctcatgggcgcagtggagggctaccgcgtcgccggggggccgttgggcgaggtgacggacccgatctacccaggtggcagcttcgaccccctcggattggcagaggatcccgaggcgtttgcggagctcaaggtgaaggagatcaagaacggacggctggcgatgttctccatgtttgggttcttcgtccaggccatcgtcaccggcaagggaccgttggagaatctgtccgaccacctggccgatccggtgtctaacaatgcctgggcatatgccaccaacttcacccccgggtcctagacggatgccaaggggatcttccagggcatggtggcaaaaagaggcgaatcttttcgttggcgacgacattggctgggggttctgtttcttttcttcttcta

SEQ ID NO: 1378 - DNA, 695 bp, Artificial
  Synthetic
gctcttcattgccctctctctcaatctctagctcgctatagaaatggccgcatcgatcagcagctcctcattctccggccagaccgcgctcaagtctcccaatgagctcgccaggaaagtcgggaatctgggagaagcgcgcaccgtgatgcgaagaaccagagcaagcactccggagagcatttggtacggtccagaccgaccaaagttcctcggacctttctccgagcagaccccctcctatctcaccggtgagttccccggtgattacggctgggacaccgctgggctttccgccgatccggagacgtttgcacggaaccgggagctggaagtcatccactgccgctgggccatgcttggagctctcggctgcgtcaccccggagctgctgtccaagaacggcatcaagtttggagagtcggtgtggttcaaggccgggtcacagatcttcaaggaaggtggtctggactacttgggaaatccaaaccttgtccatgcacagagcatccttgctatctgggcttcccaggttattcttatgggtcttgtggaaggatacagagttggaggtggacctctaggtgaggggcttgacaagatctatcccgggggtgcgtttgatccactgggacttgctgatgatccggatagctttgctgagctcaaagtgaaggaggtgaagaatggaaggc

SEQ ID NO: 1379 - DNA, 679 bp, Artificial
  Synthetic
gcgccatctctctcagctctcacagctcactgcatcaatggccgcggccaccatggcgctctcctccccggtgatggcccgcgcggcgccgtcgacctcctccgcgctcttcggcgaggcgcggatcaccatgcgcaagaccgccgcgaagcccaagccggcggcgtcgtcggggagcccgtggtacggcgccgaccgcgtcctctacctcggcccgctctccggcgagccgccgagctacctcaccggcgagttcccgggcgactacgggtgggacaccgcggggctctccgccgacccggagacgttcgccaagaaccgggagctggaggtgatccactcccggtgggcgatgctgtgcgcgctcggctgcgtcttcccggagctcctcgcccggaacggcgtcaagttcggcgaggccgtgtggttcaaggcgggctcgcagatcttcagcgagggcgggctcgactacctcggcaacccgagcctgatccacgcgcagagcatcctcgccatctgggcggtgcaggtggtgctcatgggcgccgtcgaggggtaccgcatcgccggcgggccgctcggcgaggtcgtcgacccgctctaccccggcggcgccttcgacccgctcggcctcgccgatgaccccgaggcgttcgcggagctcaaggtgaaggagatc

SEQ ID NO: 1380 - DNA, 1117 bp, Artificial
  Synthetic
gcagcagcagcagcagctgagcttgaagcagcagagcgaggtagacatggccgccgccaccatggccctctcgtccccggcgctggccggcaaggccgccgcgaaggtgttcggcgaggggcgcatcaccatgcgcaagtcggcggcgaagcccaagcccgccgcgtcggggagcccgtggtacggcgccgaccgcgtgctctacctcggcccgctctccggcgagccgccgagctacctgaccggcgagttccccggcgactacgggtgggacaccgcggggctctccgccgacccggagacgttcgccaagaaccgggagctggaggtgatccactccaggtgggcgatgctcggcgcgctgggctgcgtgttcccggagctcctcgcccgcaacggcgtcaagttcggcgaggcggtgtggttcaaggcggggtcgcagatcttcagcgagggcgggctcgactacctcggcaacccgagcctgatccacgcgcagagcatcctcgccatctgggcggtccaggtggtgctcatgggcgccgtcgaggggtaccgcatcgccggcgggccgctcggcgaggtcgtcgacccgctctaccccggcggcagcttcgacccgctcggcctcgccgacgacccggaggccttcgcggagctcaaggtgaaggagatcaagaacggccgcctcgccatgttctccatgttcggcttcttcgtccaggccatcgtcaccggcaagggccccctcgagaacctcgccgaccacctcgccgaccccgtcaacaacaacgcctgggcctacgccaccaacttcgtccccggcaagtgagcgccgccgccgccgtgctgccatggcgacgcatcgccttcagctaagctagctaggttgacgacgatgcgcgtctctgcaggagagtgtgcgtgtgtgtacgcggtgcagtagatgtacgtacgtgtaccgtatagatgtacgtattcgtgtggaccgcgtggatggatgtacgagtattggagagaaggtgagatctgtaccggtagtgtgtatttctgtgcaggttctgaacctgatcaatgaaatatggtgttgtgaattaattataaaaacaaaaaaaaa

SEQ ID NO: 1381 - DNA, 1091 bp, Artificial
  Synthetic
cccacgcgtccgaaaaaccaacccaaccgccgccgcatcgccctcgttagaacgatggccgcgtcggggctgcaccagaccaccagcttcctcggcaccgcccctcgccgggatgagctcgtccgccgcgtcggcgactccggtggccgcatcaccatgcgccgcaccgtcaagagcgcgccccagagcatctggtatggacctgaccgtcccaagtacctgggcccgttctcggagcagacgccatcgtacctgaccggagagttcccgggagactacgggtgggacacggcggggctatcggccgacccggagacgttcgcgaggaacagggagctggaggtgatccactcgcggtgggcgatgctgggggcgctgggctgcgtcttcccggagatcctgtccaagaacggggtgaagttcggggaggcggtgtggttcaaggccggcgcgcagatcttctccgagggggggctcgactacctggggaaccccaacctggtgcacgcgcagagcatcctcgccatctgggcggtccaggtggtgctcatgggattcgtcgagggctaccgcgtcggcggcggcccgctcggcgagggcctcgacaaggtgtacccaggcggcgccttcgacccgctcggcctcgccgacgaccctgacaccttcgccgagctcaaggtgaaggagctcaagaacggccgcctcgccatgttctccatgttcggcttcttcgtccaggccatcgtcaccggcaagggccccatcgagaacctcttcgaccacgtcgccgaccccgtcgccaacaacgcctgggcatacgccaccaacttcgtccccggcaagtgagcacaacgacacgatcgagatggtgccaaccaacgtaccatgtgtacacttgtagtagccacgcaccgaccctgcagttgcagttgcagcagtgcatgtatgtatgtaccttaattgtgtgtgtgtgtgtgatcgatcgaggagatttctagcttaattaatttctgtctgtcatcatctttgcttctttggatcgagatttaatgtaagccgcaggccgcatccaagggatgatcgaattaatg

SEQ ID NO: 1382 - DNA, 950 bp, Artificial
  Synthetic
aaaaaagaagcttctttagctcaccaattaaacaaatggccacttctgcaattcaagaatctgcatttgttggccggacagtggctaaatcacaaaatgagcttgttaggaaaattggcagctttggcggaggccgtgctaccatgagacgtactgttaaaagcgctcctcaaagcatctggtatggagaagaccgtccaaaatatttgggcccattctctgagcaaactccatcttaccttactggtgaatttcccggtgattacggatgggatactgctggactctcagctgacccaaagacatttgccaaaaaccgtgaacttgaggtgatccattgtcgttgggccatgcttggtgctttgggttgtgtcttccctgaaattctatcaaagaatggtgttaaattcggtgaagcagtttggttcaaggcaggagcccaaatctttttagaaggtggacttgactaccttggcaacccaaaccttgtccacgcccagagcatcctcgccatttgggcttgccaagttgtcctaatgggcttgattgaaggatacagggttggtggaggcccacttggtgaaggtcttgacaagatctatccgggaggtgccttcgacccacttggcctagctgatgatcccgaggcttttgctgagttgaaggttaaggaaatcaagaatggacgattggctatgttttcaatgttcggattctttgttcaggctattgttacaggaaaaggcccaatcgagaacctttacgaccacattaatgacccagtagccaacaatgcttgggcttttgctaccaactttgtacccggaaagtgaaatgtttagtctgtgctatatgtaaaaattagggctaatgaagttctctgcttgtaaaagattgggctgttcctactatttaacatgctgatgtttctgcagaagatactgaatatt

SEQ ID NO: 1383 - DNA, 357 bp, Artificial
  Synthetic
aattcggcacgaggtgatcttgaggtgatccattgccgttgggccatgcttggtgctttgggttgtgtcttccctgaaatcctttccaagaatggtgttaaatttggtgaggcagtttggttcaaggctggatctcaaatcttctcagaaggcggtcttgactaccttggtaacccaaaccttattcatgcacagagcattcttgctatttgggcatcccaagttgtgctcatgggtttaattgaaggatacagagttggtggaggcccacttggtgaaggtcttgacaagatctatccgggaggagcttttgacccactagggctcgctgatgatcccgaagcatttgctgaattg

SEQ ID NO: 1384 - DNA, 940 bp, Artificial
  Synthetic
gaattcaggtaagaatggcaaccatggctctgtcttctccatcatttgcaggcaaagctgtgactctaaacccgggaacagaattcccaaccaatgtaagatctggcagcaacagcaagatctcgatgaggaagacatccgcaaagaagcctgctgcttcttcaggaagtccatggtatggtccagaccgtgtcaagtacctcggtcccttctctggtgagtctccatcctacttaactggtgaattcgctggtgactatggctgggacactgctggactatcagctgatccagagacctttgccaagaaccgcgaacttgaggtgatccattcaaggtgggcgatgcttggcgctttgggctgtgtcttccctgaactcctctcgagaaatggagtcaaattcggcgaagcagtttggttcaaagccggctctcagatattcagtgaaggaggacttgactatttgggaaattccagcttggttcatgcacagagcatcctggctatatgggccactcaagtcatccttatgggcgccgtcgaaggctacagagttgctggcggtccactaggtgaggttgttgatcccctttacccaggtggaagcttcgatccattaggcctcgcagaggacccagaggcatttgccgagctaaaggtaaaagaactaaagaacgggcgacttgctatgttctccatgtttgggttcttcgttcaggctattgtgacgggcaaaggtcctctagagaacctggcagaccaccttgccgacccagtgaacaacaatgcctggtcatatgctacgaacttcgctcccgggaagtgagcataagcatagcaaaggcaaaatggagtttgatttcctactttttttctgtaatatcctctgtacattcatttagcttgtaaaattgtgtagaatgtagctgcggttggtct

SEQ ID NO: 1385 - DNA, 1135 bp, Artificial
  Synthetic
acgcgtcgccacgcgtcggcatctctctcagctctcacagctcactgcatcaatggccgcggccaccatggcgctctcctccccggtgatggcccgcgcggcgccgtcgacctcctccgcgctcttcggcgaggcgcggatcaccatgcgcaagaccgccgcgaagcccaagccggcggcgtcgtcggggagcccgtggtacggcgccgaccgcgtcctctacctcggcccgctctccggcgagccgccgagctacctcaccggcgagttcccgggcgactacgggtgggacaccgcggggctctccgccgacccggagacgttcgccaagaaccgggagctggaggtgatccactcccggtgggcgatgctgggcgcgctcggctgcgtcttcccggagctcctcgcccggaacggcgtcaagttcggcgaggccgtgtggttcaaggcgggctcgcagatcttcagcgagggcgggctcgactacctcggcaacccgagcctgatccacgcgcagagcatcctcgccatctgggcggtgcaggtggtgctcatgggcgccgtcgaggggtaccgcatcgccggcgggccgctcggcgaggtcgtcgacccgctctaccccggcggcgccttcgacccgctcggcctcgccgatgaccccgaggcgttcgcggagctcaaggtgaaggagatcaagaacggccgcctcgccatgttctccatgttcggcttcttcgtccaggccatcgtcaccggcaagggccccctcgagaacctcgccgaccacctcgccgaccccgtcaacaacaacgcctgggcgtacgccaccaacttcgtccccggcaagtgaagtgggggaccgtagcttagcagtggttaattgtggttggatggatttgtggccagcgagttcgttgtctttgggttggggaagatgggtttagtgcgacgagatgatgatcgagttggtgttgtgtacactaagaagatgaagaagaagatgatgtttttgcaataatgattttattcgtttcccaactaatggtctaggtacttatccgtggtgttattctggttagcggatttctcatctctattagatcggaaacaaatacttccctcgatcccaaaatat

SEQ ID NO: 1386 - DNA, 846 bp, Artificial
  Synthetic
gaattcactagaaaaagagagtcatggccacctctgccattcaaaggtctgcattcgctggtcaaactgctttgaagcaacaaaatgagttcatccgcaaagttggcaatgtggaaggtggtcgtatctccatgcgccgcactgtaaaaagcattcagtcaagcatgtggtatggaccagacagacctaagtacttgggaccattctcagaacagaccccatcttacctcactggtgaatttccaggtgactacggttgggacacagccgggttatctgctgacccagagacatttgcaaagaaccgtgaactcgaagtgatccactgcaggtgggctatgttgggtgccctaggatgtgtcttccctgaggttctctcaaagaacggtatcaactttggcgaggcagtatggttcaaagctggatcacagatcttctctgagggaggtttggactaccttggaaaccctaacttggtacatgcccaaagcattcttgcaatctgggctactcaggttgtgctaatggggtttgttgagggatacagagttggtggtggtccacttggagaaggactagacaaactttaccccggtggatcttttgaccctctaggattagctgatgacccagagtcattctctgaattgaaggtaaaggaaatcaagaatggaagacttgctatgttctctatgtttgggtatttcgttcaggctattgttaccggaaagggtccaattgaaaacctttatgaccacgtcgccgatcctgttgcaaataacgcatgggcttacgctactaactttgctcctggaaaatgaatgtaaattttcctagggtgtatca

SEQ ID NO: 1387 - DNA, 618 bp, Artificial
  Synthetic
gtcaagttcggcgaggccgtgtggttcaaggcgggctcgcagatcttcagcgagggcgggctcgactacctcggcaacccgagcctgatccacgcgcagagcatcctcgccatctgggcggtgcaggtggtgctcatgggcgccgtcgaggggtaccgcatcgccggcgggccgctcggcgaggtcgtcgacccgctctaccccggcggcgccttcgacccgctcggcctcgccgatgaccccgaggcgttcgcggagctcaaggtgaaggagatcaagaacggccgcctcgccatgttctccatgttcggcttcttcgtccaggccatcgtcaccggcaagggccccctcgagaacctcgccgaccacctcgccgaccccgtcaacaacaacgcctgggcgtacgccaccaacttcgtccccggcaagtgaagtgggggaccgtagcttagcagtggttaattgtggttggatggatttgtggccagcgagttcgttgtctttgggttggggaagatgggtttagtgcgacgagatgatgatcgagttggtgttgtgtacactaagaagatgaagaagaagatgatgtttttgcaataatgattttattcgtttccc

SEQ ID NO: 1388 - DNA, 811 bp, Artificial
  Synthetic
tcaaaccaagaatgctaaccctcttagggatgttgtccgtatgggctctgccaaattcactatgggaaatgacttatggtatggaccagaccgtgtcaagtacttaggacccttttctgctcaaactccttcatacttgaccggagaattccctggtgactatggttgggacactgctggtttatctgctgatcctgaagccttcgcgaagaacagagctcttgaggttatccatgggagatgggcaatgcttggagcactaggttgcatcaccccagaagttcttgaaaaatgggtgaaagtagacttcaaagaaccagtatggttcaaagcaggagctcaaatcttcagcgaaggcggacttgactacttaggcaaccctaaccttgtgcatgctcagagtattctagctgtgctaggtttccaagttgtgctcatgggacttgttgaaggttttagaattaatggacttcctggagttggagaaggcaataacttataccctggtggtcaatattttgacccacttggcctagccgatgaccccacaacctttgctgagcttaaggtaaaggagatcaagaacggaaggttggcaatgttctccatgttcggattctttgttcaagctattgttaccggcaaaggccctcttgagaacctattggaccaccttgacaaccctgttgctaacaatgcttgggtttatgccacaaagtttgttcctggagcttaagatgattttgtcttatgtctcaattctagtgttttgtgtaattgtatcttcagaaatgcaaatatggtgtagatg

SEQ ID NO: 1389 - DNA, 517 bp, Artificial
  Synthetic
tggcgatttgggcatgccaggtggtgctgatgggagctgtggaagggtacagagttggtggcggcccgctaggagaagggctcgacccaatataccccgggggtgcattcgacccactcgggctggccgacgaccccgagtcgtttgccgagttgaaagtgaaggagattaagaacgggaggctagcgatgttctcgatgtttgggttcttcgtgcaggcgatagtgacagggaagggaccgatcgagaacctttccgaccacttggcggatcccgcgatcaacaacgcatgggcttacgccaccaactttgtccctggaaagtaggccattatcttttattagccccacctctctctctcttcttctgtacaaaagacatctcagatttaggcttcatatgtttcatcatgagttttttttagcccctccttgcaaagagggggaagctcctatttggaattgtttctcctcttttttaatcattaatcctatgaatcaatgaaactctttgatgg

SEQ ID NO: 1390 - DNA, 979 bp, Artificial
  Synthetic
tggtatcaacgcagagtggccattacggccggggatcacaactaactttgacatctcaaactagcaacctctcactttcctcttgataaaccatggctgcttctacaatggctctttcttccccttctttcgctggacaggcagtgaaactctccccatctgcctcagaaatcactggaaatggaagggtctccatgagaaagactgtcgccaaacccgtcgcatctagcagcccatggtacggtccagaccgtgttaagtacttgggcccattctccggtgaggccccaagctacttgaccggtgaattcccaggtgattacgggtgggatactgctggactttcagcagatccagaaacttttgccaagaaccgtgaactcgaggtgatccactgcagatgggctatgcttggtgctcttggatgtgtcttccctgagcttttggctcgtaacggtgtcaagtttggtgaggctgtgtggttcaaggctggatcacaaatctttagtgagggtggacttgactacttgggcaacccaagcttggtccatgcacaaagcatcttggcaatctgggcttgccaagttatcttgatgggagccgttgagggttaccgtgttgctggtgggcctcttggtgaagttgtcgacccactctaccctggtggcagctttgacccattaggccttgctgatgacccagaggcatttgccgagctcaaggtaaaggagatcaagaatggcagacttgccatgttttctatgttcggattctttgttcaggccattgttaccggaaaaggtccattggagaaccttgctgaccaccttgcagaccccgttaacaacaatgcgtgggcctacgccacaaactttgttcccggaaagtgaatcttaaaacattctcaaaattctgattgtttgatggccttgtaaagctgttgtgagttacctgacaatataatgcgattttgtttgtg

SEQ ID NO: 1391 - DNA, 290 bp, Artificial
  Synthetic
tggtatcaacgcagagtggccattacgccgggggggattgatccagtcacacaccagccaattactgttaaccaaccaaacatagaacagccaacaaaaaatcaaccaattattcaacaagaaaaacaaacaacaatgccaatttccccatctcatgttgtcccagaaataatggatattcttgatcacaacaaggagctggttgaaactcctatattatcaacaatcacagatatcaaattagacgacgacaacaacaataacagcaatatcaacaataataagaatac

SEQ ID NO: 1392 - DNA, 576 bp, Artificial
  Synthetic
ccccggaaacagcagcggctccagctcgccgtggtcgactttcccggcggcgatcaccggcagcggaggaggagcagtacgtgtgtatatataaaggatggggaggcagccgtgctgcgacaagctgggggtgaaaagggggccgtggacggcggaggaggacaagaagctgatgagcttcatcctgaccaacggccattgctgctggcgcgccgtgccgaagctcgccgggctgctccgctgcggcaagagctgccgcctccggtggacaaactacctccgccccgacctcaagcgcggcctcctcaccgacgccgaggagcagctcgtcatcgacctccacgccaagctcggcaacagatggtccaagattgctgccaagctaccgggcaggacggacaacgagatcaagaaccactggaacacgcacatcaagaagaagctcatcaagatgggcatcgacccggtgacgcacgagcccctcgaccggaagcaggagagcccggccaccacctcgcagtccaccgtcacggcggagtcgtccaagtccggcgaggcgaccaggcagcaaagccg

SEQ ID NO: 1393 - DNA, 629 bp, Artificial
  Synthetic
gctgtttgttttggcgataccatttgcatggcttgcccagcatcgtcgtcgtcgtcgtcgggagcaaggaggaggagagaccatcgatcttgattgatttgaagctagatggcggaggaggcgaagaaggtggaggtgaccaaggacatcgccgaagagaaggcagtggtgccgctgccgacgccgccggccaccgagcacgacgactccaaggccatcgtcctcgtcaaggaagctgaggctacaggaggttcagctgaaagagatgcttatctcgcaaaaattgtgtcggagaagagattggtactgatcaatgcctgggaggaaagcgagaaagctagagcagagaacagggcggccaagaagctgtcatacatcacttcatgggagaatgcaaagaaagcagagatggaggctgagctgaaaaggatcgagcaagaactggagaagaagaaggcggcgtacgaagagaagctgaagaacaagctggcattgctgcacaagacggcggaggagaagagggcgctcaccacggcgaagcgtggcgaggagctgatcatggcggaggagatggccgccaagtaccgtgcaaagggcgaggctccgacgaagctgttcgggctcttgaa

SEQ ID NO: 1394 - DNA, 602 bp, Artificial
  Synthetic
ccgagagggaacactcgagcgatccgtccgtccgcccgcccgtcgtcgtcgcgcgccagggctgaggaggaggccaagaaggtggaggtggaggtcaccgaggcgccacccgccgctgccgctgccgcggagacggagccggctgccaaggacgtcgccgaggagaaggccgtcatccccgcccccgcgccgccggccgaggaggagaagcctcccgtcgacgactccaaggctctggccatcgtcgagaaggttgcagatgaacctcctgccgagaaacctgctcaagggggctctaatgacagagatgttgctcttgcaagggtggaaactgagaagaggaactcattgatcaaagcatgggaggaaaatgagaagacaaaagctgagaacaaggcttcgaagaagctatctgctattctttcctgggagaacacaaagaaagcaaacatagaagctcaactgaagaagattgaggagcaactggaaaagaagaaggctgaatatgcagagaagatgaagaacaaagtcgcgatcgtccacaaggaagctgaggagaagagagcaatggtcgaggcaaagcgcggcgaggaagtcctaaa

SEQ ID NO: 1395 - DNA, 899 bp, Artificial
  Synthetic
gggcggacgcgtgggcggacgcgtgggaaaagatctttcatctttcatttctgagactctgattctgttccaaatcctagaattcttcttttttctgaattctgtttgtagccatggcagaagtagaagctacgaaagtggagactgagaaagttgtggaccctactccccctgcacctgaggctcctgcacctgttaaagaagcagaacctgttgttgaaactcctaaagaagtggctgatgagaaagctatagttgcaccagctctgcctcctcctgaacaagtcaaagaaaaatccgatgattctaaagcactagttgtcgttgaagataaacctgctgaggagaaaaaggagggatctattgacagagatgctgtgcttgctcgagttgcaacagagaagagactgtcactaatcaaagcatgggaggaaagtgagaaatcaaaagccgaaaacaaagctcagaaaaatgtatcagcaattgctgcatgggagaatagtaagaaagcaaacctggaggctgagctaaaaaagatggaggagcagctggagaaaaagaaggcagaatatattgagaaaatgaaaaacaaaatcgctctactccacaaggaagctgaagaaaagagagcgatgattgaagctaaacgtggagaagatcttcttaaggcagaggaattggcagcaaaataccgcgccactggaactgctcccaagaaactccttggatgtttttgaagcagcaaacattagacctgcatcgatggtgattgaaaatgcttttgtaaagtttgtgcaattggaatttttttcttcttattagatacattgtgtgattatgtattttagaatcaatcattgtttattattatgtgtgcatagtgatgtattccattgtat

SEQ ID NO: 1396 - DNA, 735 bp, Artificial
  Synthetic
tttttggattccttctatttatataaataaatatattcgtttaacaatatggcagaagcaattccagtacctcaagaaccagctgttgatagttctccagctgccatggctaccaaagctgatgattctaaagctctcgccactgttcctccaccaaagactgattcttcaacaaagaagagttcaaagggatccctcgatagagacattgctctcgcacaccttgaaacagagagaaggaattcttatattaaggcatgggaagaaagtgaaaaaagcaaggtggaaaacaaggccgaaaagaagctctctgcagttgggacatgggagaacaccaagaaagcaaatcttgaagctaaactgaagaaacttgaggagcaactagaagaaaagaaagcagaatatgcggagaagattaaaaatagagtagccgcagttcacaaggaggctgacgaaaagagagctatggttgaagccagaaagggagaagaacttcttaaagcagatgagatggctgccaagtatcgcgccaccggacaagcccctaagaagttgcttggatgccttggatgctaaagctgtgaaaagtttgtttctcttttgtaaattttcaggcttgttgctctttattgggtgtttcaaacatgtcgagtttcctatttgtgtatgaaaagcactcatgaaaattttaagtgttacgataattataactccacttcagatgtttctactaga

SEQ ID NO: 1397 - DNA, 637 bp, Artificial
  Synthetic
gcagcatggcggaggaacagaagatagcgttagaatcagaatctccggcgaaggttacgactcctgctccagcagatacaccggctccagctccggcagagattccggctccagctccagctccgactccggctgatgtcacgaaagacgttgcagaggagaaaattcaaaacccacctccggagcaaattttcgatgactccaaagcccttactgttgttgagaaacctgtagaagagcctgcaccggcgaaacctgcgtctgcatcgctcgatagagatgttaagctagctgatttgtcaaaggaaaagagattgtctttcgtcagagcgtgggaagaaagcgaaaagagcaaagcagagaacaaagctgagaagaagattgcagatgttcatgcttgggaaaacagcaagaaagcagctgtcgaagcgcaactcaagaaaatcgaggagcaactagagaagaagaaagcagagtatgcagagaggatgaagaataaggttgcagcgattcacaaggaagcagaagagagaagagcaatgattgaagctaagcgtggagaagacgttcttaaagcagaagaaacggctgctaaatacagagccactggaattgttccaaaggcaacttgtggatg

SEQ ID NO: 1398 - DNA, 941 bp, Artificial
  Synthetic
cccgaacactcgagcgatccgtccgtccggccgcccgtcgtcgtcgcgcgccatggctgaggaggaggccaagaaggtggaggtggaggtcaccgaggcgccacccgccgctgccgctgccgcggagacggagccggctgccaaggacgtcgccgaggagaaggccgtcatccccgcccccgcgccgccggccgaggaggagaagcctcccgtcgacgactccaaggcgctggccatcgtcgagaaggttgcagatgaacctcctgccgagaaacctgctcaagggggctctaatgacagagatgttgctcttgcaagggtggaaactgagaagaggaactcattgatcaaagcatgggaggaaaatgagaagacaaaagctgagaacaaggcttcgaagaagctatctgctattctttcctgggagaacacaaagaaagcaaacatagaagctcaactgaagaagattgaggagcaactggaaaagaagaaggctgaatatgcagagaagatgaagaacaaagtcgcgatcgtccacaaggaagctgaggagaagagagcaatggtcgaggcaaagcgcggcgaggaagtcctaaaggccgaggagatggcagccaagtaccgtgccaccggccatgctcccaagaaactcatcgggtgctttggggcctaaagaaattttcgattcacaacgagcaaacgtgaaagtgttcatcagtggttgctttgcttctttcaccctcccaagtgcgtagtgtgtttgttggtgcaagaaaggtcgtgcctggtgtgtaaagtctggtgttgctgtatataacatattactcccaagacagatatgtttggtgctgtacatgtttgatgcttgacaggcaacattcttatgtgtagttaagaagccacattgttattgttattgacagtaagctgtttgttctttt

SEQ ID NO: 1399 - DNA, 796 bp, Artificial
  Synthetic
gaattcatgaagaacaaatctcagtataaacgagaaaaatctactacgtagagccgttctaaagctcggttaagaatacaaatggaaaatcaaaccctatgcttaaaaatattcttccttttgttacataaattttaggaagaaaatgaagaacaagagccatacaaattctcatgtgtcctctatgaatggcttctcttgcaaccttagctgttgtacaacctaccgtcgttaaaggcctcggaggaagctccatcaccggaaccaagctttcggttaagactactgctcgtcgtagtctgagacaaactaaaatcaggactggtgccgtggttgccaaatacggtgacaaaagtgtgtacttcgacttggaagacatcggtaacactaccggacaatgggacttgtacggttctgatgcaccatctccctacaactctctccagagcaaattctttgagacatttgcagctccattcaccaagagaggtttgttgctcaagttcttgataattggaggaggttcaacacttgcatacttgagttcaacagtctcaggtgacatcttaccaatcaagaagggtcctcaattgcctcctaagatgggtccacgtggaaagatctaaatgctgaaaatggaaactcgacatcctttgtggttgagttacagtttatcttaattttcagaatttgtaactatgacattggtttataactagtcttgttttcgtgtgtacatcataaacgattcggttcgaaggcaatttaagatcattttatgatataaaaaaaaaaa

SEQ ID NO: 1400 - DNA, 612 bp, Artificial
  Synthetic
  misc_feature (3)..(3): The residue at this position can be any nucleotide.
acaaaagaatagtgatcgaagctcatggcggggcttgcaaccgtcgccgctgtgaaaccatccgccgccataaaaggactcggcggcagctcactcgccggagctaagctctccatcaagccttcccgcctgagctttaaacccaaatccatccggtaactaaaacttttcatttattcattaattaggatcaaaatgccactataaccacactataaattcaaaatatattaatagatttttgctggctgaagtgtgttttaaacgatagatatagtgatgattaattagctttaaaaggattaaattctgataatttcatctcttggttgggattaaattagcttgagggtggtgtgttcatgtgtaatagggctaatggtgtggtggctaagtatggagacaaaagtgtctactttgacttagaagatttgggtaacacaacaggtcaatgggacgtatacggctctgatgctccttctccttacaatcctcttcagagcaaggtctttgagacattcgctgccccattcacaaagagaggattgctcctcaagttcttgatccttggaggaggctctttgcttacttatgtcagcgctacctctaccg

SEQ ID NO: 1401 - DNA, 577 bp, Artificial
  Synthetic
aacggatagaagaacactcttgtaagaggcgatggccgccgcaacagcagcagcattggtaccgtctggacttgccaacagcagcttgaatggaacgaagctgcgaatcaagcctgcaggacaagtctcaatgagaagatccactgccaagctcggtgtatcggcaaagtatggagaaaagagcatctacttcgatcttggagatatcaacaacaccaccggagcttgggacttgtatggatctgatgcaccttctccttacaacggactccagagccgattcttccaaatcttcgctggtgctttcaccaaaaggggcctgttgctaaagtttctgctgcttgccggtaccggtgctgtcgcttacgctggagttaaggcatccccgacttacctccctgtcaagaaaggagccgtcgggccgccaacgccaggtcccagaggaaagatctaaactccattccaaattaccgagaccatccctgttctgtaagttcgccaccaggaatgtaatcttcttccttctagtggatatagatcgaaagcttgcagggagagtctgcggcaatgcagcttc

SEQ ID NO: 1402 - DNA, 424 bp, Artificial
  Synthetic
aattcggcaccagaaaattcccactcaccacacacaacaaaagaatagtgatcgaagctcatggcgtctcttgcaaccgtcgccgctgtgaaaccatccgccgccataaaaggactcggcggcagctcactcgccggagctaagctctccatcaagccttcccgcctgagctttaaacccaaatccatccgggctaatggtgtggtggctaagtatggagacaaaagtgtctactttgacttaaaagatttgggtaacacaacaggtcaatgggacgtatacggctctgatgctccttctccttacaatcctcttcagagcaagttctttgagacattcgctgccccattcacaaagagaggattgctcctcaagttcttgatccttggaggaggctctttgcttacttatgtcagcgctacct

SEQ ID NO: 1403 - DNA, 329 bp, Artificial
  Synthetic
gcgcttactttggcaacaaacaaacaacaacaaagagagaaattaacatggcgtcttttgcaaccatcgccgccgtacaaccttctgccgccgtgaaaggacttggaggtagctctcttgccggagctaagctcttcatcaaaccttctcgccaaagcttcaaaaccaaatccaccagagctggtgctgtggtggctaagtatggagacaaaagtgtatactttgatttagaagatttgggtaacacaacaggacaatgggatgtgtatggatctgatgctccttctccttataacccacttcagagcaagttctttgagacatttgct

SEQ ID NO: 1404 - DNA, 645 bp, Artificial
  Synthetic
gccattacggccggggagtaaaccacataattaattagggacagctttcctagtttggacagaaaactatggcgtctttggcaactcttactgcagttcagcccaccaccacaatcaaaggactagctggaagctccattgctggaacaaagcttcatgttaaatcatctcgtctcaatttgaagctctctaaatccagggctggtgctgtggtagcaaaatatggtgacaagagtgtatattttgacttggaggatttgggcaacaccactggccagtgggacttgtatggatcagatgcgccttcaccctacaactcccttcagagcaagttctttgagacatttgctgctcctttcacaaagagaggtctgttgctcaagttcttgattttgggaggtggctcaactcttgcttacttcagttcaactgcatcaggggatatcctaccaatcaagaaagggcctcaacttccaccaaagctcgggccacgtggcaagatctaattgcttttcgatccaaatttcttgaccttcatttcataattgatgtactatctatcacagcttgtaagtataaattaaagcctttctcagacctcttttcaacaagtaaatcttctagaaaatttgatgcattgctttc

SEQ ID NO: 1405 - DNA, 610 bp, Artificial
  Synthetic
aaggatagcagagagagagagagagagagccatggcaggattagcatcgacatcttccgccgtagcatgcggtgtgacctcgtcttctctctctggccagaagcttgctattgcgcactccaacctctctcttcccagggctagcccaagagcgggagtagctgtcgctaaatatggtgagaagagtatgtactttgaccttgaagatatcggtagcactaccggttcttgggacctctatggagccgatggaccttccccctataatggattgcagagcaagttctttgagacaactgcaggagcatttacccgtcgaggcattcttttgaagttcttggtcttgggtggaggcggcactcttgcctacgttagctccactgcaggaaaagttgtcctgcccatcaacaaaggacctcaggagccccctaaggttggaccccgaggcaagatctgagtattaactctatgtatcaaatctatctctcatgtggattccaaaagaactgataaatccagataagttggcttttctgtgtaattagtttttgttcctgttagttgtgaatgcaacaaattctatgaattgggtgaccaaaaaaaaaaaaca

SEQ ID NO: 1406 - DNA, 673 bp, Artificial
  Synthetic
ccccccggccgccgcagatagtacaccggctatctatccatctatctactcagctttgcgtcctcccgcgaattcaccgcagcaatggcgtccctcgtcgccgtccagccggtcgccgtgaagggcctcgccggcagctccatctccggcaggaagctcgccgtcaggccgtcgccccgggcgctctgccgcaccacccgcaggccgcgcgccgccgtggtggccaagtacggcgagaagagcgtctacttcgacctcgaggacatcggcaacaccaccgggcagtgggacctgtacggctccgacgcgccgtcgccgtacaaccctctccagagcaagttcttcgagacgttcgcggggcccttcaccaagagggggctcctgctcaagttcctgctgctcggcggcggatcgctggtggcctacgtcagcgcgtcggcgtcgccggacctgcttccgatcaagaagggcccgcagctgccgccgacgcccggcccacgcggcaagatctgaattaaattcctcgtctctgcctcaccttcttcttgatccgatccatccatgcaaatcctctgtactgtactgctagtcccccatggccggatcgccatggattaattccccctgtttatgatgttgatataattgtactattcctatggctatataagtt

SEQ ID NO: 1407 - DNA, 530 bp, Artificial
  Synthetic
ggccccaaattcagctaaaaaaaaaactggttataagggaaagcccccaattatacatacttacccaaacggggaaacatacatcaattacaaaaaaaaggtggataatgggaccaaaaattaattaaatcttgccacggggcccaagcttggggggaagttggggacctttcttgatggggaggaaatcccctgatgctgccaaactgaagtaggcagggggggacccccctcccaatatcaaaaatttgaccaaaaaacctttttgggggaagggaccaccaaatgtctaaaaaaacttgctctaaaaaaagttgtatggggaaggggcatttgatccatacaggccccactggccaggggggttgcccaaatcctccaaatcaaagtataccctcttgccaccatattgggcgaccacaaacccagccctggattaagggggcttcaaattgaggcgagatgatttgaaataaagtttattcccagaaagggaccttccagctaggcccttgacattggccgaaggt

SEQ ID NO: 1408 - DNA, 712 bp, Artificial
  Synthetic
cgtgcacgtacgtgtagccgccgccgcagatagtacaccggctatctatccatctatctactcagctttgcgtcctcccgcgaattcaccgcagcaatggcgtccctcgtcgccgtccagcctgtcgccgtgaagggcctcgccggcagctccatctccggcaggaagctcgccgtcaggccgtcgccccgggcgctctgccgcaccacccgcaggccgcgcgccgccgtggtggccaagtacggcgagaagagcgtctacttcgacctcgaggacatcggcaacaccaccgggcagtgggacctgtacggctccgacgcgccgtcgccgtacaaccctctccagagcaagttcttcgagacgttcgcggggcccttcaccaagagggggctcctgctcaagttcctgctgctcggcggcggatcgctggtggcctacgtcagcgcgtcggcgtcgccagacctgcttccgatcaagaagggcccgcagctgccgccgacgcccggcccacgcggcaagatctaaattaaattcctcgtctctgcctcaccttcttcttgatccgatccatccatgcaaatcctctgtactgtactgctagtcccccatggccggatcgccatggattaattccccctgtttatgatgttgatataattgtactattcctatggctatataagttgtaaaggatccaattcgatgctgcatg

SEQ ID NO: 1409 - DNA, 294 bp, Artificial
  Synthetic
tggtatcaacgcacagtggccgttacggccggggatctaaagctagctttgctagttttaacttgaagtgaagactatggcatctttggcaactcttgctgcagtacaacccacaactgccgtcaatgggctagctggaagctccattattggaactaagctacatgttaaatcatctcgctttaatttgaagtctactaaatccagggctggctctgtggtagctaagtatggagacacgagtgtatactttgatttataggacttgggcaacaccactgggcagtgggactt

SEQ ID NO: 1410 - DNA, 605 bp, Artificial
  Synthetic
ggaacaaggatagcagagagagagagagagagagccatggcaggattagcatcgacatcttccgccgtagcatgcggtgtgacctcgtcttctctctctggccagaagcttgctattgcgcactccaacctctctcttcccagggctagcccaagagcgggagtagctgtcgctaaatatggtgagaagagtatgtactttgaccttgaagatatcggtagcactaccggttcttgggacctctatggagccgatggaccttccccctataatggattgcagagcaagttctttgagacaactgcaggagcatttacccgtcgaggcattcttttgaagttcttggtcttgggtggaggcggcactcttgcctacgttagctccactgcaggaaaagttgtcctgcccatcaacaaaggacctcaggagccccctaaggttggaccccgaggcaagatctgagtattaactctatgtatcaaatctatctctcatgtggattccaaaagaactgataaatccagataagttggcttttctgtgtaattagtttttgttcctgttagttgtgaatgcaacaaattctatgaattgggtgacgaaca

SEQ ID NO: 1411 - DNA, 382 bp, Artificial
  Synthetic
aattcggcacgaggagaaattaacatggcgtcttttgcaaccatcgccgccgtacaaccttctgccgccgtgaaaggacttggaggtagctctcttgccggagctaagctcttcatcaaaccttctcgccaaagcttcaaaaccaaatccaccagagctggtgctgtggtggctaagtatggagacaaaagtgtatactttgatttagaagatttgggtaacacaacaggacaatgggatgtgtatggatctgatgctccttctccttataacccacttcaggtttttgtacactcttaaatctttagatctatatgcttcttcaaattctaagactttgtgattatgttgcttgcagagcaagttctttgagacatttgct

SEQ ID NO: 1412 - DNA, 719 bp, Artificial
  Synthetic
tctaaatcaaggatatcagaggtgctagtggtgctatcgttgtaaagggaagatggctcaagcagtagcgatggccgggctttgctcatccctctcctcggccgcttcctcgctcgacggggccggctctcgcctcttggcctcctccccttcttcctctgccccctctaaaccatcccttcgcctccctttaatccgcgctagctcgtcgaatccctcagaagacgcttctgctaaatctagtactagacgccaaatcttgtccctcgttgctgtctctgctttgcttgtctctaaacaagccctcgccgaccctagccctatcaagctctttggccctcccgccccttctggtggcctccctgggactgaaaatgccgacgaagctcgagatctagacttgccattgaagaatagattttacctgcaacctcttcctcccgtggaagcgatcgccagggcgaaggaatctgccaaagagattgtgaatgtgaaggcattgatcgacaagaaggcttggccctatgtccagaacgggctccgatcacaggcttcctacctgcgctttgacctcaacactgttatcgcttccaagccgaaggatgaaaagaaagctctcaaaagccttagcactaagctctttaacactatcaataatctggactatgctgctagaagcaaaagtaccacccaggcggagaaatattatggagaaactg

SEQ ID NO: 1413 - DNA, 285 bp, Artificial
  Synthetic
tgttggatggtcagctctgtggttcagcccgtttgagcactgttagcaccagcagaattgccttggctagaccaggtctcagcattagagcccaacaggggtctgctgacactgaaactagccgtagagccgtcatcggtcttgttgctgctggccttgctggttcctttgctcaagcagcctttgctgcagctaaatcaatcaagattggtggcgctcctcctccctccggtggattacctggaactttgaactcggatgaggcaagggactttggtctaccac

SEQ ID NO: 1414 - DNA, 909 bp, Artificial
  Synthetic
cccacgcgtccgaaaaaaaatggctcaagcagtgacttcgatggctggcttacgtggagcatctcaggctgtccttgaaggaagtttacagatcaacggctcaaaccgtttgaacatctcaagagtctcggttgggtctcagagaaccggacttgtgatcagggctcagcagaacgtgtcagtaccagaaagtagtcgccggtcagtgattggactcgtggcggctggtttagccggtggttcattcgttaaagctgttttcgccgaagctattccgatcaaagttggtggtcctccacttccttccggtggcctacctggaacagataactcagaccaagcaagagacttttcattggcattgaaagatagattttacatacaaccattgtcaccaacagaagctgcagctagagccaaagattctgctaaagagatcatcaacgttaagtcatttatcgacaaaaaagcttggccctatgttcagaacgatctccgtttaagagcatcgtacctccgttacgatctcaacaccgttatctccgctaagcctaaggaagagaagcaaagccttaaagatctcaccgcaaagcttttccaaaccattgacaacttggactatgcggcgagatcaaagagtagcccagatgctgagaagtattactcagaaactgtctcgagtttgaacaatgttcttgccaagctcggttaatgaagaaagacttgcgttgtaatctgttgatgtcgatgttattataattactgctatccaagtactttgtctttctccttctcttcttgtctgatcaaatcggttatctctaatttcagtttcaagttttaaccaatatattggctggctctttagcaaaacattatatattcgtcctcgagctgacccctttgtac

SEQ ID NO: 1415 - DNA, 764 bp, Artificial
  Synthetic
ccgggggcgtccgaaaaaaaatggctcaagcagtgacttcgatggctggcttacgtggagcatctcaggctgtccttgaaggaagtttacagatcaacggctcaaaccgtttgaacatctcaagagtctcggttgggtctcagagaaccggacttgtgatcagggctcagcagaacgtgtcagtaccagaaagtagtcgccggtcagtgattggactcgtggcggctggtttagccggtggttcattcgttaaagctgttttcgccgaagctattccgatcaaagttggtggtcctccacttccttccggtggcctacctggaacagataactcagaccaagcaagagacttttcattggcattgaaagatagattttacatacaaccattgtcaccaacagaagctgcagctagagccaaagattctgctaaagagatcatcaacgttaagtcatttatcgacaaaaaagcttggccctatgttcagaacgatctccgtttaagagcatcgtacctccgttacgatctcaacaccgttatctccgctaagcctaaggaagagaagcaaagccttaaagatctcaccgcaaagcttttccaaaccattgacaacttggactatgcggcgagatcaaagagtagcccagatgctgagaagtattactccaaaactgtctcgagtttgaacaatgttcttgccaagctcggttaatgaagaaagacttgcgttgtaatctgttgatgtcgatgttattataattac

SEQ ID NO: 1416 - DNA, 726 bp, Artificial
  Synthetic
aaagaagaggagacagaagaagaagaagaagaagaaaagaagaaagagagatggcggcaatctcgtcgtctctgggcctcagcaaggcacagttcttcggctcattcgatgctagcgatgcggcgagaggctcttcttctcgcgttggaatcgcgagatcgaagtgtgtgatccgcgcgatgcagcaagaacacgatccgtcgagacgagcagcagtctttggcctggtcgcagtggccgcgggcgtactggccgtggaggaatcgcgagcagtgagtggaatcaagatcaatgggccacctccaccatccggaggacttcctgggacggagaacgccgatcagccgcgcgacttggatctgccactcaaagagcgatttttcatccagccgctgtcgccagccgaggcagtggatagaatcaaggacgcgtcgaaggacattgtgggagtaaaggagctgatcgagaagaagagctggccgtatgtccgcaacgatcttcgcagcaaggcgacttacttgaggtatgacatcaaaaccatcctggatgccaagcccaaggcccagcgcaaagagctcaagaaatacacggacagtctcttcgacacaattgacaagcttgactatgcagctcgagcaaaggatcccgcagccgcgagcaagtgctacagcgacaccgtagctgcattggacactgttattgccaaaatctcggcataaatatata

SEQ ID NO: 1417 - DNA, 648 bp, Artificial
  Synthetic
gaattcagtagctcacaagctgtcttggaaggtagccttcaactcaacagctctacccgcttgagtggagttagtaacaaccgagtaagcgtgatcagtcgatctagtttcacagttaaagctcagtcatcggacaatgaagccgtagctcagagtagtcgcagagctgtcttgggactagtagctaccggattggtaagtggctcattcattcagcgtgtgcttgctgaagcaaggccaattaaggtcggatcacctcccaagccatccggtggattgcctggaactcttaactcagaccaggctagagaccttgatctaccattgaaggagaggttcttccttcaaccactgtctccaacagaggctacacaaagagctaaagaagctgctaaagagattcttaacgtgaagagtaacatagacaagaaggcatggccttacgttcagaacgatcttcgttcccaggctggatatcttcgttatgacctcaaaactataatttcttcaaagtccaaggatgagaaggcttcgcttacagatctcaccaacaaactctttatttcccttgacaaactggacaatgcagcaaagatcaaaagcagtgaagcagcagcaaagagttatgccgatgctgtagtgtctttg

SEQ ID NO: 1418 - DNA, 873 bp, Artificial
  Synthetic
cccgatctgaagagagaaattctcagcttatagtcaggtgaggtctgagctgaggttgggagatggcacaggcaatggcgtccatgaccgggctgtcgcagggcgtgcagctgccggccgggcccaggcgcgccggcggcaggtccaggctcgccgtcgtcagggccgacgccgccgccgccgacgtccagaccggccgccgcgccgtgctcggcctcgtcgccaccgggatcgccggcggcgccctcgcgcaggcggcgctcgccgaggccgccaagcccatcaagctcggccccccgccaccgccctccggtggactccctgggacgctgaactcggaccaggcgagggacacggacctgccgctgagggagaggttctacctgcagccgctgccgccggcggaggcggcggcgagggcgaaggagtcggcccaggacatcatcaacctcaagccgctcatcgagaagaagcagtggccgttcgtcagggacgacctccgcctcagggcctcctacctgcgctacgacctcaaaaccgtcatcaactccaagcccaaggccgagaagaagggcctcaaggacctcaccggcaagctcttcgccaccattgacgggcttgaccatgcagccaagatcaagagccccgaagaggcggagaagtactacacgttgaccaaatctgctcttggcgatgtcctcgccaagctaggctaggatcggcataatggccatatggggtttcggtgtttttatgtttgttcatatggaaccggcaatgtaccctccatgttgatattgtatcagcaagcacttacgtatgattcaatcttgagttgttgttgacggctaaatctccaagcaggcgcgatta

SEQ ID NO: 1419 - DNA, 820 bp, Artificial
  Synthetic
gaattcaatggcgcaagctatagcatcagtatctggcttaagcagcttctcgcaaggtacaaacagattgaatgtggctactaccaacagccgaacggccagaagtcgtgttggtttcagcgttagatctgagaagaagtcggaatcggagactgctcagagtagccgtagagcactattgggtgtcttagctgtgggactaaccactggatctttcgtgaagaatgtgcttgctgatgctaggcctattgtaatcgggccacctcccgctccttccggtggtttaccggggactctaaattctgatgaagcaagggacttagatctacccctaaaaacaaggtttttcctacagcctaagactccagaagaagcagctcaaagagtaaaagaatcagcgcaagcgatcctaggtgccaaggcacagatagacaaaaaggcatggccgtatgtccagaatgaactacgatccagcgccgaatatcttcgttacgatctcagaactatcatctctgcaaagcccaaggatgagaagaaaccactcaaagaactgtctgacaagcttatccaaaacctcaatagtctggactatgctgcaaaggttaagagcactcctgaagcagagaagtactatgccgaaacagcagcatcattaaaagaagttctagcaaagattggttaagagatacttgtcaagagctgaacatcaattattttattcttcttcctgatgaaactgagtgacgattttgtcattcccgaacaatcattgctgtattacttttttttggtatgatcaaaggatgaatataaccatata

SEQ ID NO: 1420 - DNA, 869 bp, Artificial
  Synthetic
gtaccacaacattaacttataatttcccccacgctacttctatcaccctgcctaaaacaaatttcagaaggttcaccaaaatggctcatgctatggcttcaatgggtggcctaattggttcttctcaaactgtgttggatggtcagctctgtggttcagcccgtttgagcactgttagcaccagcagaattgccttggctagaccaggtctcagcattagagcccaacaggggtctgctgacactgaaactagccgtagagccgtcatcggtcttgttgctgctggccttgctggttcctttgctcaagcagcctttgctgcagctaaatcaatcaagattgggggcgctcctcctccctctggtggattacctggaactttgaactcggatgaggcaagggactttggtctaccattgaagaagaggttttaccttcaaccattgactccagctgaagcagcccagagagttaaggattcagccaaggagattgttagcgtcaagaatttcatcgacaagaaggcctggccatatgtccagaatgaccttcgtctcagagcagaataccttcgctatgaccttaaaaccgtcatctctgctaagccaaaagaagaaaagggaaaactccaggacctgactggaaagctcttcaagaccattagtgatctggaccatgcagcaaagaccaagaacagccctgaagcagagaagtactatgctgaaactgtatctaccttaaatgatgttttggccaaacttggttaaaaagcttttctgaactagtatgttattacttcctgtaacttatcgaatacttcttgaatccaattgtgaagaatgattttggaaaaattgtttaaaaatccg

SEQ ID NO: 1421 - DNA, 540 bp, Artificial
  Synthetic
tggtatcaacgcagatggccattacgccgggggcctgaaacaaatttcagaaagttcaccaaaatggctcatgctatggcttcaatgggtggcctaattggttcttctcaaactgtgttggatggtcagctcagtggctcagcccgtttgagcactgttagcaccagcagaattgccttggctagaccaggactcagcattagagcccaacaggggtctgctgacactgaaactagccgtagagccgtcatcggtcttgttgctgctggccttgctggttcctttgctcaagcagcctttgctgcagctaaatcaatcaagattgggggcgctcctcctccctctggtggattacctggaactttgaactcggatgaggcaagggactttggtctaccattgaagaagaggttttaccttcaaccattgactccagctgaagcagcccagagagttaaggattcagccaaggagattgttagcgtcaagaatttcatcgacaagaaggcctggccatatgtccagaatgaccttcgtctc

SEQ ID NO: 1422 - DNA, 607 bp, Artificial
  Synthetic
aaattctcagcttatagtcaggtgaggtctgagctgaggttgagagatggcacaggcaatggcgtccatgaccgggctgtcgcagggcgtgcagctgccggccgggcccaggcgcgccggcggcaggtccaggctcgccgtcgtcagggccgacgccgccgccgccgacgtccagaccggccgccgcgccgtgctcggcctcgtcgccaccgggatcgccggcggcgccctcgcgcaggcggcgctcgccgaggccgccaagcccatcaagctcggccccccgccaccgccctccggtggactccctgggacgctgaactcggaccaggcgagggacacggacctgccgctgagggagaggttctacctgcagccgctgccgccggcggaggcggcggcgagggcgaaggagtcggcccaggacatcatcaacctcaagccgctcatcgagaagaagcagtggccgttcgtcagggacgacctccgcctcagggcctcctacctgcgctacgacctcaaaaccgtcatcaactccaagcccaaggacgagaagaagggcctcaaggacctcaccggcaagctcttcgccaccattgacgggcttgac

SEQ ID NO: 1423 - DNA, 704 bp, Artificial
  Synthetic
ggaaagaaaagcttgacgacggagctatggcgaagcctgtggggggaggagcgaagaaggcgagggcatcccggaatagggaggtggtgcggggagtcgggcggtgtagccggtcccagatgtaccacaagaggggcttgtgggccatcaaggccaagaacggtgggtccctccctgcccatggtaagacccaggtcgcccctcaagcccccttagccaaggcccccaagttctaccctgccgacgatgtcagaaaacccctctgcaataagcgcattgctaagcctactaagctcagatccagcattacacccggaactgttctaattctccttgctggacatttcaagggaaagagagttgtcttcctgaagcaacttgagtctggattgcttcttgtcactggccctttcaagattaatggggttcctattaggcgtgtgaatcaggcatatgtgattgcaacctcgactaagctcgacacaagttccgtcgacaccagcaagttcaccgatgcatatttcaagagggaggttgagaaaaagaagaagggcgaggctgagttctttgaggctgagaaggagaagaagaccctccctcctgcaaggaaggaggatcagaaagagctcgacgctaagctggttccagtcatagagaagattccagacatgaaggcatatttgatggctagattcagtctcaaa

SEQ ID NO: 1424 - DNA, 357 bp, Artificial
  Synthetic
cccacgcgtccgaatgccggcggcgaagaggactcccaaggttaaccgtaaccctgacctaatcaggggagttggaaaatattcgaggtctcagatgtaccacaagagaggtttgtgggctatcaaggccaagaacggtggcgttttccctcgtcacgatgctcagccaaaggtcgacgctccggttgagaagcctgccaagttttatccggcggaagacgtcaagaagccgcttgttaacagacgcaagcctaagcctaccaagctaaaagccagcatcactccaggaactgtgttgatcattcttgctggtagattcaagggtaagagagttgtcttcctcaagcaactttcttc

SEQ ID NO: 1425 - DNA, 638 bp, Artificial
  Synthetic
agcaattcgaaatggcggacaccaaccccacgacccagaagttctccaagggcgagaggtcgatcccgcaccactcgcagaaggccagcaagtactaccctgctgaggacgtcgccgtccccaagaaggcccgtaagagtgttcgccctgcgaagccccgtgcctccctccagcccggttccgtcgtcatcctcctcgctggtcgtttccgtggcaagcgtgtcgttctcctcaagcaccttccccagggtgttctcctcgtcaccggtcccttcaaggttaacggcgttcctctgcgacgagtcaacgcccgctatgtcatcgctacctcgaccactgtcgacatcaagggtatcgatgagggtgtcctgaagaaggcctccgaggagggttacttcaccaaggacaaggccgcacacaagcccggagaggatgctttcttcaagcagggcgagaagcccgagaagaaggagacctctaaggaccgcgtcgaggaccagaaggccgtcgacaaggcccttcttgccaacatcaagaaggaggctcacctcgttgactaccttgcctctagcttcagcctccgcacctccgacaggccacaccagatgcagttctaagcgtagggtcaagacgggatt

SEQ ID NO: 1426 - DNA, 638 bp, Artificial
  Synthetic
catttggagaggaggcaggaagaaggaaggacgagagagagagagagagagaaagagggagagggagagatggcaaagcctgagggaggagcgaaggggccaagggcatcccggaacaagtcactggttcgaggcgtggggcaatgcagcaggtcgcagattgtaccacaagaggggtctatgggcgataaaggcgaagaacgggggctgtctaccgggtccaaaccaagcccaaagcgatggacacctcggactccaaggcccgcggcaaaaaccccaaattctaacccggcgacgacgttgccaaatccctggttaacaagcggtatatcaagcccaacaaactcagagcttagcattaccctggaactgtgttgatcctccttgctggacactttaagggaaagcgagttgtattcttgaagcagcttgagtctggactacttcttgtgacaggtccgttcaagattaacggtgtccccctcaggcgtgtgaatcaagcatatgtgattgcaacctccacaaagcttgatatcagctgcgtcaatgctagcaagatcactgatgcgtacttcaagagagaggtagagaagaagaagaagggcgaagcagagttcttcgaggctgagaaggagaag

SEQ ID NO: 1427 - DNA, 702 bp, Artificial
  Synthetic
agcgtcgcaaatcaaagatgcctcctaaggataagaaagccgcttccaccggtgctaagaccgaagccgcaggtactaaaaaggctggttccgtcagaatctccaagtggtacccagctgatgatgtcagacgtatccgcaaaaaccctgctaaagctcccaagcctgtcgccctcagaaagaacattgctccaggacaggttttgatccttcttgtaggcaggtttaagggaaagagagttgtcttcttgagacaactcaagtctggtctactcttggtcactggtccttataagattaatggtgttcctcttagaagagttaatcaaagcactgtcatccacacctctactagagttgaccttggtcaagctaaattcgataagattgatgatgattacttcaagagaataaaggccaagagaaccaagaagactgaagaagctttcttctctgctggtacccaagaaaaaccccaagaagagaaagacaagcttaatgagaagaaaaagactcaggtcgaagtagatactcctattctagccgctgttaagaagaccgaactcttaagacaatatctcagaacaagattcaccctctctaaatacactaagcctcatgaattggtcttctaagggttcagagacctgctccaaaaacatgtggatatgcttgtatgaaatagcgaagtatctatcctcg

SEQ ID NO: 1428 - DNA, 584 bp, Artificial
  Synthetic
ttccccgcagcgatggtgaaggcggcgaaggatgctgcggctaagcccaagtccaagtactacccagccgacgatgctcctgtgccgcgggcgatccggcgcaagatccgcccgacgaagctaagggcgagcatcacacctggaacggttctcatccttctcgccgggaagtacaagggcaagcgcgtagtcttcctcaaccagctcccgtcgggattattgctcgtcactggtcctcgctcgttcaatggcgtccggctcaagagggtgaaccaggcttacgtgatcgcaacatcgaccaagatcgacgtctcttccgtggacgtggccaagtacgacgacagcttcttcaagaagttgaagaaagacgaggaggtgaccccggagatgaagaaggcaaagaaggaagctcaagaggccgtggacaaggtcgtgatcgaggtgataaagaagggagagccggagctagctcagtacatctccgccaggttcagcttgaagcgtggaatgaagcctcacgagctagtgttttaaacgaggcctttttttcctaatcaaaaatcaatcgtgaagaatattccacc

SEQ ID NO: 1429 - DNA, 650 bp, Artificial
  Synthetic
acatatcagacacccgagagagtcaatatgtcggccaagcccacgaccaagcagttcgggaagtcgacccgggaggttcccgcctccgcggaccaggcgaagaagtggtaccctgccgacgacgagagcgccccgaagaaggttcgcaagtccgtccgaacttgggccccccgaaagaccctccagcctggtaccgtcctgatcctcctcgctggccgcttccgcggcaagcgtgtcgtcctcctcaagactcttgaccagggtgttctcctcgtcactggtcccttcaagatcaacggcgttcccctgcgaagagtcaacgcccgatacgtcatcgccacctcctacaaggtcgacatctccggccttgacgccgccaagattgaggagatctctcagcccaagtacttcaccgccgagaaggccaaggagaaggcttccgctgaggctttcttcaagcagggagagaagccccagaagaaggagatcaacagctacctcgccagcaccttcagcctgcggaagggtgacaagcctcacgagatggcgtggtaaatttgattcaaacacaaaatctctctggcaggtccaaagcacggggtggagtttactggggtgttggtcaagatgcgggttgtaaaacggaaagg

SEQ ID NO: 1430 - DNA, 630 bp, Artificial
  Synthetic
ggcaggaagaaggaaggaggagagagagagagagagagagagggagagggagagggagagatggcaaagcctgagggaggagcgaaggggccaagggcatcccggaacaagtcactggttcgaggcgtggggcaatgcagcaggtcgcagatgtaccacaagaggggtctatgggcgataaaggcgaagaacgggggctgtctaccggtcctcaccaagcccaaagcgatggacacctcggactccaaggccgccgccaaaacccccaaattctaccccgccgacgacgtgcccaaacccctggttaacaagcgtataatcaagcccaccaaactcagagctagcattacccctggaactgtgttgatcctccttgctggacactttaagggaaagcgagttgtattcttgaagcagcttgagtctggactacttcttgtgacaggtccgttcaagattaacggtgtccccctcaggcgtgtgaatcaagcatatgtgattgcaacctccacaaagcttgatatcagctgcgtcaatgctagcaagatcactgatgcgtacttcaagagagaggtagagaagaagaagaagggcgaagcagagttcttcgaggctgagaaggagaagaag

SEQ ID NO: 1431 - DNA, 986 bp, Artificial
  Synthetic
ccgctcaaaaactagggtttactctctcgccagagcagcttctcttctccaatggcgcccaagaaaactctccgtaacccagaactaattcctggcctgggaaaattctcacgttctaaaatgtaccacaagaaaggtctctgggcaatcaaaaagaaaaacggcggcacatttccatcccacagcaaaaaacctgccgccgccgctccggtaataaaacccccaaagttttatcccgccgatgacgtagcaaaaccgcttgtgaacaaacacaagccaaaacctacaaaactcagagcaagcattacacctggaaccgttttgattatcctagctggtaagtttaaggggaaaagagttgtgttcttgaaacagcttgcgtctgggcttctgcttgttactggaccgtttaagcttaatggagttcctttaagacgtgtgaatcaagcttatgttattggtacctcgactaaggttgatgtttcgggtgtgaatgtggagaagtttgatgataagtattttgctaagcaggttgagaagaagcagaagaagggagaagaggagttttttgaagacaagaaagaggagaagaatgtgcttccacaagtaaagaaagatgaccagaaaaccgtagatgcagctttgctcaaggccattgatggagttcctgaattgaaggcttatttgtccgcgaggttctcactcaaggcagacatgaaaccacatgaacttgtcttttagaggaacaacatctacaacacttttttttggataaattgattttgttacgctctatttttctgttttgttcggtttgaacctgcgtttataggtcatattgaggatttgctgattataaacatctttaattagaatatatatgcaatatgagagttttcttgttgaaaacaaaaaagttagacgttttaaagctggtgatattcttgctttgcctgctggtgttacacactggacttacaatgatg

SEQ ID NO: 1432 - DNA, 765 bp, Artificial
  Synthetic
ccggctctcgccctctccgcaccagctccccgccgagagcgccgcgagctgatccaatggcgccgacgtcgaagctgtcgcagggcatcaagaaggcgtcgcggtcgcacacgtaccaccgccgcgggctgtgggccatcaaggccaagcacggcggcgccttccccaaggccgagaagcccgccgccgcagccgccgccgccgcgcccaagttctaccccgccgacgacgtcaagccccgccagcccagcacccgcaagcccaaccctaccaagctcaggtcgtccatcacgcctgggacagtgctgatcctgctcgccgggaggtacatggggaagcgcgtcgtgttcctcaagcagctcaagtccggcctgctcctcatcaccggaccttttaagatcaatggagtgcccatccgccgtgtgaaccaggcctacgtcattgccacatccacgaaggttgacatctctggtgttaaggtggataagtttgatgacaagtactttgcccgggacaagaaggcaaaggccaagaagaccgagggtgaactttttgagacagagaaggaggcaaccaagaatctgcccgacttcaagaaggatgaccagaaggctgtggatgctgagttgatcaaggctatcgaggttgtcccagacctgaaatcctatcttggtgcccggttctctctcaggtacggcgacaagccccatgagatgacattctaagttagtcggtacaagtttcaagttctgaggaagtcttttt

SEQ ID NO: 1433 - DNA, 492 bp, Artificial
  Synthetic
aattcggcaccagaaaaaaggaaaagagagaaagagaaatctttctgtcttaagtgtaattaacaatggcttcctcagttctttcctcagcagcagttgccacccgcagcaatgttgctcaagctaacatggttgcacctttcactggtcttaagtctgctgcctcattccctgtttcaaggaagcaaaaccttgacatcacttccattgccagcaacggcggaagagtgcaatgcatgcaggtgtggccaccaattaacatgaagaagtatgagactctctcataccttcccgatttgagccaggagcaattgctctccgaaattgagtaccttttgaaaaatggatgggttccttgcttggaattcgagactgagaaaggatttgtctaccgtgaacaccacaagtcaccaggatactatgatggcagatactggaccatgtggaagctacctatgttcggatgcactgatgccacccaagtgttggctg

SEQ ID NO: 1434 - DNA, 958 bp, Artificial
  Synthetic
tggtatgaacgcagagtggccattacggccggggaaaaaaaaaggaaaagagagaaagagaaatctttctgtcttaagtgtaattaacaatggcttcctcagttctttcctcagcagcagttgccacccgcagcaatgttgctcaagctaacatggttgcacctttcactggtcttaagtcagctgcctcgttccctgtttcaaggaagcaaaaccttgacatcacttccattgccagcaacggcggaagagtgcaatgcatgcaggtgtggccaccaattaacaagaagaagtacgagactctctcataccttcctgatttgagcgtggagcaattgcttagcgaaattgagtacctcttgaaaaatggatgggttccttgcttggaattcgagactgaggtcaatatttgttctaaattttgcatactccttcaattttatgctcacattttttttccttctatttgttcctaaaaaaagagtgacatatttatacatttagaaaaaaattaacttttaactttaatatattatttcacatgttgcagcgcggatttgtctaccgtgaacaccacaagtcaccaggatactatgatggcagatactggaccatgtggaagctacctatgttcggatgcactgatgccacccaagtgttggctgaggtgggagaggcgaagaaggaatacccacaggcctgggtccgtatcattggatttgacaacgtgcgtcaagtgcagtgcatcagtttcattgcctccaagcctgacggctactgagtttcatattaggacaacttaccctattgtctgtctttaggggcagtttgtttgaaatgttacttagcttcttttttttccttcccataaaaactgtttatgttccttctttttattcggtgtatgtttttggattcctaccaagttatgagacctaataattatgatttaaaaaaa

SEQ ID NO: 1435 - DNA, 892 bp, Artificial
  Synthetic
ctttaatatcttctctacacaacaataataatcatgggttctagctggctctctttctccttgagtttcctactggtgttgcacggtacctttgctcagcagagataccagcagcggcaaggcgaatgccaactcaatagacttagccctcaggaacccaccacccgcattcaagccgaagctggagtcaccgagttgtgggaccaaaacaaccagcagttccaatgtgctggcgtctcgctaattcgccacgtcatccagtctagaggcatgctgttgccttcttatgtcaacactcccctacttgcctatgttgaacgaggtcggggattttatggcatcatgcaatctggatgccctgaaacattccagtcgtccttgcaaatgcagcaaggtgaaaggggtgcaggctcaagattccaagatcgccatcagaggattggacagttcagacagggtgacattattgccttccctgctggagctgctcactgggcctataacgaaggaaatgaggagcttgttcttgtttgtttagaagacagcagtaacaatgccaaccaacttggtcaattttcaaggagattcttcatagctggaaacccacaacaaggacagcaacaacagggacaatacggtggcaaaagcttgcgcagggaacgattcgaatctggaaatgttttcaatggctttgacgtagaggtcttggccgaggcatttggtgtagacagggagatagcaaggagacttcaaggacaggacgaccagcgaggccacattgtaaacattgagcaaggactcagagttgtgaggccaccattctcacaagaacaagaggatcgcgaggagagacaagagcaaggacaatacggtcctcgcatgaacggaattg

SEQ ID NO: 1436 - DNA, 742 bp, Artificial
  Synthetic
accactcaaatatcactaatatggaattgcgttctcttcttcctcttgccctttgcttttttctcctctttaatggttgttttgctcaaatagagcaacagcaacgattcttatggcagaaacttcagcaacagcaacaacacagtcgtggccgagctagaactgagtgtcggatccagagccttaacgctcgggaaccgacttataaatttgaatcggaggctggaaccactgagttttgggaccgtaataatgaggaattcgaatgtgctggagttgctgctgttagaaatgttattcaacctcagggcttgctcttgcctcattacaataatgctcctcaactcctctacattgtccaagggagtggacttctgggtactgtaatacctggatgtgctgaaacatatgaatcaccacgaagagagagaggcatgaggggagaagagagcagagagggagaaagccagttcagaagtggtggtgatcaacatcagaaagtcaggcaatttagacaaggtgatgtattagcattaccagcaggtcttactctttggttttataacaatggtcaagaacgtcttgttactgtcgccttgcttgataccagcaatcctgctaaccagcttgatctccaattcaggcatttcttcctagctggaaacccaaaccctagaggacaaagtggaagcaggtacgaagaagaaatccgaggaagaagagaacaagaacaaggcgaaca

SEQ ID NO: 1437 - DNA, 821 bp, Artificial
  Synthetic
tcaaccagcccaagtttccaataacatcctcaaatagctatggcgaccatagctttctctcggttatctatctacttttgtgttcttctcctatgccatggctctatggcccagctatttggtccgaacgtaaatccatggcacaaccctcggcaaggaggttttagggagtgtagatttgatagactacaagcatttgaaccacttcggagagtgaggtcagaagccggggttacagagtactttgatgagaagaatgaacaattccagtgcacaggtacatttgtcatccgacgtgtcattgagcctcaaggccttctggtacctcgatacagcaatactcctggcatggtctacatcatccaagggagaggttctatgggattaactttccccggctgcccagcaacctaccaacaacaattccaacaattcttgcctgaaggccaaagccagagccaaaaatttagggatgagcaccaaaagatccaccaatttagacaaggagatatcgttgcactgccagctggtgttgcgcattggttctacaatgaaggcgatgcaccagttgttgctctatatgtcttcgacttaaacaacaacgctaatcagcttgaaccaaggcagaaggagttcttattggcgggtaacaacaacagggagcaacaaatgtatggtcgctcaatcgagcaacactctgggcaaaacatatttagcggtttcaacaatgagctactaagtgaggccttaggcgtcaatgcattggtagcaaagaggctacaaggccaaaacgaccaaagaggagagatcatacgggtaaa

SEQ ID NO: 1438 - DNA, 962 bp, Artificial
  Synthetic
aaaaagcattcagttcattagtcctacaacaacatggcatccataaatcgccccatagttttcttcacagtttgcttgttcctcttgtgcgatggctccctagcccagcagctattaggccagagcactagtcaatggcagagttctcgtcgtggaagtccgagaggatgcaggttcgataggttgcaagcatttgagccaattcggagtgtgaggtctcaagctggcacaactgagttcttcgatgtctctaatgagttgtttcaatgtaccggagtatctgttgtccgccgagttattgaacctagaggcctactactaccccattacactaatggtgcatctctagtatatatcatccaagggagaggtataacagggccgactttcccaggctgtcctgagacctaccagcagcagttccaacaatcagggcaagcccaattgaccgaaagtcaaagccaaagccataagttcaaggatgaacatcaaaagattcaccgtttcagacaaggagatgttatcgcgttgcctgctggtgtagctcattggtgctacaatgatggtgaagtgccggttgttgccatatatgtcactgatatcaacaacggtgctaatcaacttgaccctcgacagagggatttcttgttagctggaaataagagaaaccctcaagcatacaggcgtgaagttgaggagtggtcacaaaacatatttagtggctttagcactgaactgcttagcgaggcttttggcataagcaaccaagttgcaaggcagctccagtgtcaaaatgaccaaagaggagaaattgtccgcgttgaacgcgggctcagtttgctgcaaccatatgcatcattgcaagagcaggaacaaggacaaatgcaatcaagagagcattatcaagaaggacgatatcagcaaagtcaatatgggagtggctggcctaacggtttggatga

SEQ ID NO: 1439 - DNA, 588 bp, Artificial
  Synthetic
ggttcgttagcccaacttcttagccaaagtactagtcaatggcaaagttctcgccgtggaagtccaagagagtgcagatttgatcggttgcaagcatttgagccgattcgcactgtaaggtcccaagctggtacaactgagttttttgatgtctctaatgagttgtttcaatgtactggagtatttgttgtccgtcgagttatcgaacctagaggtcttctgttacctcactactccaatggagcaactttggtatatgtcatccaaggcagaggtataacaggaccaactttcccaggatgtcctgagacctatcaacaacagtttcagcaatccgagcaagaccaacaattggaaggccaaagccaaagccataaatttagagatgaacatcaaaagatccaccgttttcaacagggggatgtagttgcattgcctgctggtgttgctcattggtgctacaatgatggtgatgcaccaattgttgccatatatgtcactgatatatacaatagtgctaaccaacttgatcctagacacagggatttctttttagctggcaacaataagataggtcaacaattgtat

SEQ ID NO: 1440 - DNA, 1148 bp, Artificial
  Synthetic
ctattagcttaagtttccataagcaagtacaaatagctatggcgagttccgttttctctcggttttctatatacttttgtgttcttctattatgccatggttctatggcccagctatttaatcccagcacaaacccatggcatagtcctcggcaaggaagttttagggagtgtagatttgatagactacaagcatttgaaccacttcggaaagtgaggtcagaagctggggtgactgagtacttcgatgagaagaatgaattattccagtgcacgggtacttttgtgatccgacgtgtcattcagcctcaaggccttttggtacctcgatacacaaatattcctggcgtggtctacatcatccaagggagaggttctatgggtttaaccttccccggttgccctgcgacttaccagcaacaattccaacaattttcatctcaaggccaaagtcagagccaaaagtttagggatgagcaccaaaagattcatcaatttaggcaaggagacattgttgcactcccagctggtgttgcacattggttctacaatgatggtgatgcacctgttgttgccgtatatgtttatgacgtaaacaacaacgccaatcagcttgaacccaggcaaaaggagttcctattagccggcaacaacaatcgggctcaacaacaagtatatggtagctcaattgagcaacactctgggcaaaacatattcagcggatttggtgttgagatgctaagtgaggctttaggcatcaacgcagtagcagcaaagaggctacagagccaaaatgatcaaagaggagagatcatacatgtgaagaatggccttcaattgttgaaaccgactttgacacaacagcaagaacaagcacaagcacaagatcaatatcaacaagttcaatacagtgaacgacagcaaacatcttctcgatggaacggattggaggagaacttttgcacgatcaaggcgagagtaaacattgaaaatcctagtcgtgctgattcatacaacccacgtgccggaaggataacaagtgtcaatagtcagaagttccccatccttaacctcatccaaatgagcgctaccagagtaaacctataccagaatgctattctctcgccgttctggaacgtcaatgctcat

SEQ ID NO: 1441 - DNA, 790 bp, Artificial
  Synthetic
aatatcttctctactcaataataataatcatgggttttagctggctctctttctccttgagtttccttctggtgttgcacggtacctttgctcagcagagataccaacagcagcaaggcgagtgccaactccatagacttagtcctcaggaacccaccgtccgcattcaagccgaagctggagtcactgagttatgggatccaaataaccagcagttccaatgtgctggtgtctccctaattcgccacgtcatccagtctaggggaatgctgttgccttcctatgttaacacacccctacttgcctatgttgaacgaggtcagggattttatggcatcatgcaatctggatgcccggaaacattccagtcatcccagcaattgcagcaaggtgaaaggggtgccggttcaagatttcaagatcgccaccagaggattggacagtttaggcagggtgacattattgccttccctgctggagctgctcactgggtttataacgaaggaaatgaggagcttgttcttgttgttcttgaagatagcagtaacaatgccaaccagcttggtcgaacttcaaggaggttcttcatagctggaaacccacaacaaggacagcaacaacagcaacaaggacaatacggtggccgcagcttgcgcagggaacaattccaatctggaaatgttttcaatggctttgacgtacaggtcttggctgaggcatttggcgtagaccaggagacagccaggagacttcagggacaggaagaccagagaggccacattgtaaacat

SEQ ID NO: 1442 - DNA, 750 bp, Artificial
  Synthetic
gggaaaaatggcttctaactcctctctcatttgttttagcctttgtttcctctttctttttcatggtacttttgctcagatctttgagcaccagcaagtttggcagaggatgcaacagcagcagcaacatcgggcgctcaggtccagaactgagtgccgaattgagcgcctgaatgctcaagagcctactcgtaggttcgagtctgaggctggtgtcaccgagttctgggatcacactcaggaacaatttgagtgcgccggagtccaagcagttaggcatgaaatccgacgaaatgggcttttgttgccttactacagcaacactccccagctcatctatataattcaaggaaatggagtgcattcggctgtgttcccgggttgtgctgagacattcgagacagagtcagcacaatcgaggaggggagaaaggggagaaagaggagaagcaggacaaagattcaatgaccgtcaccagaaagttagacgttttagagctggtgatattcttgctttgcctgctggtgttacacactggacttacaatgatggtgaagaaccaattatcagtgtctctcttattgacacttctaaccaggccaatcaacttgatctcaccttcaggaaatttttccttgctggaaatcctcaacgtggtgtacaacaacaaatgttaggaaggcaacaggagggagctcctggcctaggaagaagaggtagtgaacaagagagaggaagcaacatcttgag

SEQ ID NO: 1443 - DNA, 625 bp, Artificial
  Synthetic
gagagagagagagcttggattttttggaaaggagagagagagagagagggtgcacctcttttttttcactcttaagtttatttttgctctatttttatatttcctcttcttcgatccgcatcgctctgctctgctctgctcctccctcgtcagaactttgtgcagaacctagggtcctttcggggggaaaggggggggcagagaaggacccatcatggcctacagagcagatgaagagtatgactatctattcaagcttgtgctcattggagactctggagtgggcaagtcaaacctcctctctagattcactcggaacgaattcagtctcgattccaaatcgactattggtgttgagtttgccacgcgtagtctaaacgtcgacgggaagatgatcaaagcccaaatttgggacaccgccggccaagaaaggtatagagccatcacaagtgcatactatcggggcgcagttggcgcattgcttgtgtttgatgtgactaggcatgtcaccttcgagaatgtcgagaggtggttaaaagagcttaaagatcacactgacgcgaatgcggttgtcatgcttgttgggaacaagagcgatctccgccaccttcgggcggtttcaacg

SEQ ID NO: 1444 - DNA, 439 bp, Artificial
  Synthetic
tctgattctttcgcctctgtcgagaatcatcataaatggcggcggccggctctaccaatctgcaagctaaattggtgcttctaggcgatatgggagcgggaaaatccagcctagttttgcggtttgtgaaagaccagtttcacgaataccaggagtcaacaattggtgcagctttcttttcgcaaactttaactgtggatagcacaactgtgaagtttgaaatttgggatacagcaggtcaggaaaggtatcacagcttggcacctatgtattaccggggagctgctgcagctattataggatatgacatcacaaatcttgattcatttactcgagcaaagaagtgggtacaagagcttcaaaagcaaggtaaccaaaatctggtcatgggcctcgctggaaacaagggcgatctaacatccaaaagaaaagttgaatc

SEQ ID NO: 1445 - DNA, 565 bp, Artificial
  Synthetic
gcccaagccttgagattcccaagccagatctcagcagctaggcagtagcagcttggcagtgtggaagtcatggcatcagagttcgatcatctatttaagttgcttcttataggagattcgggtgtaggcaagagtagtttgctcttgcgctttacatcgggcacctttgatgacctttcgcctactgttggtgttgattttaagctgaaaacaatgactttggaggggaagaggttaaagctcacaatttgggatacagctggccaggagcgatttcgtacacttacaagctcttattatagaggtgcacaagggataatactcgtttatgatgtgacaagacgggagacattcactaacctttcagatgcatggttgaaagaagttgagctatactctacccaccaagattgtatcaagatgcttgttggtaataaagttgacatggagtcggagcgtgtcgtcaccaaaagggagggtatagcattcgcaaggcaacatggctgcttattcattgaaagcagtgctaaagcaagagttaatgttgagcaatgctttgaggagc

SEQ ID NO: 1446 - DNA, 592 bp, Artificial
  Synthetic
ttcctcgattcgaagaacaagaagcagaaggagaagaagaggaagaaggaatagccctacccttatcgctcaacggaaaataattcctgccccccataataataataataataatacctttcaatccattcaattgcttccgataattcccctctcttcccaattcgccggccatccgggttcaaaactccccgtggggaacgcgcagcactgtttttcagcctacccatcgacgacccttgtgaagatgtcctaccagtatctcttcaagtatatcatcattggcgacacaggcattggcaaatcatgcctcttgttgcagtttacagacaagagatttcaacctgtacatgatcttaccattggagttgagtttggggctcgtatgatcacaattgggaacaagcctattaagttgcagatttgggatactgcaggacaagaatcatttcgatctatcaccagatcatactaccgcggtgctgcgggtgcattgctggtctatgatatcaccaggcgagaaactttcaaccatcttgcaagctggctggaagatgctcggcaacatgccactacaaatatggttatcatg

SEQ ID NO: 1447 - DNA, 775 bp, Artificial
  Synthetic
aattaatttttaaaaatttcccttgctccttccggcagatcgatcccctttccttccttctttttctctttctatctcttcttcttttctctctcccgtctttgctctgccttgttgttgacgagaagaagaagaagaaggagaaggaggtggagagtaaggatcgatggccgcctctggagcagctcgagctcgtgaccatgactacctcgtcaagctgctcctcatcggggatagcggtgttggcaagagttgcttgcttctccgattttctgatgacacgttcactacaagtttcatcacgaccataggaattgattttaagatcagaactattgagatggatggaaaaagagtaaagctccaaatatgggacactgccggacaagagcgctttaggacaattactacagcctattacagaggcgctatgggtatcattcttgtgtatgatgtaacagatgagtcgtctttcaacaatattcgcaattggattaggaatatagaacagcatgcttctgacaatgtcaacaagatattagtaggcaacaaagctgatatggatgagagcaagcgggcagtgtcacatgaacgcggtcaagcacttgccaatgaatataacttgaacttcttcgagacaagtgccaaaacaaatatgaacgtggagcaggtctttttcaccattgcaagagatatcaagcaacggttaacggatgctccttcgaagactgaggcggcggcaatcagcatttcaaagccgaaccaacaagacaac

SEQ ID NO: 1448 - DNA, 568 bp, Artificial
  Synthetic
aaagagggaagatcatcgtgcatcgcgcggaggtctggatcggcagcgctaatggcggcggggagagcgcgggcggactatgactacctcatcaaattgctgctcatcggcgacagcggtgtggggaagagctgccttttgctgcgcttctcggacgattccttcacgacgagcttcatcacgacgataggcattgacttcaaaatcaggaccgttgacctggatggcaagaggatcaagcttcaaatttgggacactgctgggcaagaacgcttccggacgatcacaactgcatactaccgaggagctatgggcattctcctcgtctacgatgtgacggatgaatcatcattcaacagaatatcgagcagcacgcgtcggacaatgtgaacaagatcctggtcggcaacaaggccgacatggacgaaagcaagagggccgtatcaacagaaagagggcaagctcttgcgaacgagtttggtatcaagttcttcgaaaccagcgcgaagacgaacatgaacgtggagaacgtcttcttcacaatcgcgggagacatcaagcggagact

SEQ ID NO: 1449 - DNA, 662 bp, Artificial
  Synthetic
gagcaacgttggcgaatccacgaagaaagaagggaaagcggtgccatcgcgggcaggagcagggccagatctgagctgcgccgccatcgatcgacgacccaatccactgccgcagctaaggcgccgcgagatccggaggtcttttgcagggatttcggggattttcgctggtttttcttgatctcttcctcggttctgcgaagaagacgcatcggcagcaatgaatcccgagtaggtttcgattcgcgagcgattgacctcgccctctttgcagtgactatctcttcaaactcctcctaattggcgactctggcgtcgggaaatcgtgcctgctgctacgattcgcggatgattcttaccttgagagctacatcagcaccatcggggtggacttcaaaatccgaacagtggagctggaagggaagactatcaagctccaaatctgggacactgctgggcaagagcgcttcaggactatcacgagcagttactatcgtggagctcatggcataatcgtcgtgtacgacgtgactgaccaggaaagcttcaacaacgtcaagcagtggctcaacgagattgatcgctacgcgagcgagaatgtgaacaagctcctcgtcgggaacaagtcggatctcactgccaagaaggtggtcgacactcag

SEQ ID NO: 1450 - DNA, 619 bp, Artificial
  Synthetic
gcaaatacgatgaataccgaatacgactacctcttcaagctgcttctcattggagattctggtgttggcaagtcttgtcttctgcttcgattcgccgacgatacctacactgactcttacatttccactatcggtgttgattttaagatcagaactttagagctggaaggaaagaccgtcaagctgcagatttgggatactgccggacaggagcgtttccgaaccatcacttcttcatactaccgaggagcccacggtatcattgtcgtctacgatgtgactgaccaggacacattcaacaacgtcaagacttggttccacgagattgaccgatacgccaccgagggcgtcaacaagctgcttgtgggtaacaagtccgatatcaccgacaagaaggtcgtagagtacactgtggccaaggagtttgccgactctctgggcatccctttcctggagacctcggctaagaacgccaccaacgttgagcaggcatttttgaccatggcacgtcagatcaaggagcgaatgggcggagctgccgagaacaccgccgccaaggccaatgtcaacctccgaggccagaatgtctctcaaggttccagcagctcttgctgttaac

SEQ ID NO: 1451 - DNA, 585 bp, Artificial
  Synthetic
cacgcagacgcgcaccaacccgccggcatgcgcgtccggatgctttgctttgcccgccgcgattcgatccacgcctgagcgagcgagcggggcgagcaacgcgcccttccttcccttgccatggcctcttcaccggcgagcagctacgactggtccttcaagatcctgctcatcggggactcggccgtcggcaagagcagtctgctcgtcagcttcgtctccgcctcccacatcgacgacgaaatcgctcccaccataggggttgactttaaaatcaaatttctcactgtcaatgggaagaaactgaagctaacaatatgggacactgctggccaggaaaggtttaggggaatcacaagttcttactacagaggtgcccatggcatcattctagtgtatgatgtcacaaagagagaaagtttcacaaatttggctgatgtatgggccaaggaaatagaattgcattcgacaaataaagagtgcatcaaaatgcttgtcgggaacaaggtggacaagaatgaggaaaggatggtgacaagggaagaaggtcttgcctttgcccaggaatctggatgtctttttctt

SEQ ID NO: 1452 - DNA, 609 bp, Artificial
  Synthetic
ctttcctagtcttcttctccgccactccgaggcggcaaggaggaagatctcggaggcggtgcccggaggaggtgaggcgagatgggcgggcgggtggatcacgagtactcgtacctgttcaagatggtgctgatcggcgacagcggcgtcggcaagtctaatatcctctcccgcttcacccgcaaccacttctccctcgactccaagtccaccatcggcgtcgagttcgccaccaaatccctgcagatggagggcaaaacaataaaggctcagatctgggacacagcaggacaggagagatatcgtgccatcacaagtgcttactaccgtggcgctgttggggctctccttgtttacgacatcacaaagaggcagagcttcgacaatgtccacaggtggcttcgtgagctccgcgaccatgccgactcgagcattgttatcatgatggtcggtaataagtctgatttgattcatctaagggctgtctccgaggatgaaggtaaggcattggctgaaaaggaggggctgttttttcttgagacatcagctatggaggccgtgaatgtggaggaagcctttcagactatcatcacagaggtctatggcatt

SEQ ID NO: 1453 - DNA, 317 bp, Artificial
  Synthetic
agctctggaaacaagaacatcaacgccaaattggtattactaggagatgttggagctggaaaatcaagtcttgtgctacggtttgtgaaagatcagtttgttgaatttcaggaatcaaccattggtgcagcttttttctctcaaacattggctgtgaatgatgcgactgtgaagtttgagatatgggatacagctggtcaggaacgataccacagtttggctccaatgtactacaggggtgcagctgctgctattattgtctttgacattactaatcaagcctcatttgagagggcgaagaaatgggttcaggaact

SEQ ID NO: 1454 - DNA, 472 bp, Artificial
  Synthetic
cccacgcgtccgctacaattcctctgtcgctctcaccagttaacagctacagcacaaaactgtaaccacgcttccgatctctaaaacctgagagagagagagagagagagagagacagagagaagtgtttcaatagtttggcgtgaagatggccggaggaggcggatacggcggcgcatcggggaaagttgattacgtcttcaaagttgttctaatcggagattcggctgttgggaaatcgcaactacttgctcgattcgctagagacgaattcagcatggattctaaagccaccatcggcgtcgagttccaaactcgtaccctctccattgaacaaaaaagcattaaggctcagatctgggataccgctggtcaggaaagatacagagccgttacaagcgcatactacagaggagcagttggcgcaatgctggtttatgatatgacgaaacgtgagacctttgagcatatt

SEQ ID NO: 1455 - DNA, 340 bp, Artificial
  Synthetic
cccacgcgtccgctctggctctgtatcgctcgctgctcttcctcccacagatcgaaaaccatgaatcctgagtacgactatcttttcaagctcctgcttatcggggattctggcgtaggcaagtcttgtcttcttttgagattctctgatgattcttatgtagaaagttacattagcactattggagtcgattttaaaattaggactgtggaacaagatggcaaaacaattaagctccaaatttgggacactgctggtcaagaacggttcaggactattactagcagttactaccgtggggcacatggaattattattgtctacgatgtcacagatgaag

SEQ ID NO: 1456 - DNA, 636 bp, Artificial
  Synthetic
acgcgtcgaggctggaagcaagcgatcttttatttctcttctcctctcgccagatcgatcgccgccggctcaggccagttcttccgggagatccagcgctatggcctacagatcggacgaggactacgactatctcttcaaggtagtgttgattggcgactcgggcgtcggcaaatccaacctcctctccagattcacgcgcaacgaattcagcctcgaatccaagtccaccatcggggtcgagttcgcgacccgtagcatcaacgtcgacggcaagctcgtcaaggcacagatttgggacaccgccgggcaggagagatatcgagcgatcaccagcgcctactaccgcggcgccgttggcgctctcctcgtctacgacatcacccggccggtgacgttcgagaacgtggagcggtggctcaaggagctcaaggaccacaccgattccaacatcgtggtgatgctggtggggaataagtccgacctgcgccacctccgggccgtgtccaccgaggacggccaggccttctccgagcgcgaggggctctacttcatggagacgtcggccctcgagtcgaccaacgtggagaatgcgttcaagcagatactgacgcagatttaccgggtggtgagcaa

SEQ ID NO: 1457 - DNA, 1028 bp, Artificial
  Synthetic
cccacgcgtccgctacaatgcctctgtcgctctcaccagttaacagctacagcacaaaactgtaaccacgcttccgatctctaaaacctgagagagagagagagagagagagagacagagagaagtgtttcaatagtttggcgtgaagatggccggaggaggcggatacggcggcgcatcggggaaagttgattacgtcttcaaagttgttctaatcggagattcggctgttgggaaatcgcaactacttgctcgattcgctagagacgaattcagcatggattctaaagccaccatcggcgtcgagttccaaactcgtaccctctccattgaacaaaaaagcattaaggctcagatctgggataccgctggtcaggaaagatacagagccgttacaagcgcatactacagaggagcagttggcgcaatgctggtttatgatatgacgaaacgtgagacctttgagcatattccgcgttggcttgaagaactgagggcgcacgctgataagaacattgtcatcatccttattggaaacaagtctgatctagaagatcaaagagctgttcccactgaagacgctaaagagtttgctgagaaggaaggactctttttcctcgagacctctgctttaaacgcaaccaatgtcgaaaactccttcaacactctaatgactcagatatacaataccgtgaacaagaagaatcttgcatctgaaggcgactcaaataaccccggttcattggctggtaagaagattctcatcccaggttctggacaggagattcccgctaagaccagcacttgttgtacttcttcttgatctgtctcctactcaagcaagattcattttttttcctcctgaaatttgtgatagagaatgctactttcattgtatattctttttcgaatctggcttgtttgctagttcattaaacattggtgtgcaattggacaccgatagaaagtattggaacaaatagcttttgaatgaaatatgaaacaaacagtctttgagagttaaaaaa

SEQ ID NO: 1458 - DNA, 574 bp, Artificial
  Synthetic
aatacaacatggccaccccaagaacgtcttgtcaagagcgatttgcacagttcaaactcgtgttattaggtgagtgagagagggtctatgctactctcttctggcttctttcagcgactccaccacaagaagaaaatgggaatggagcaaagcatctttggtgtgatctttgggtacaagaaagggtgcaagctaggtcagattcgtatcagaaccgctttgcctgtcacttgcttgatgttactaacacaggtgaatcgtttgtgggtaaatcctcgctggtgacccggttcgtcaaggacgagtttctcgagcagagagaatcaactatcggagcagccttcctgacccagactgtctctctggaagacaacaagacagtccggttcgagatttgggatactgccggacaggagcgatacaagtcgctggcccccatgtactaccggaacgccaattgtgctgtggtggtctatgacattacacaggcctcgtcattggagcgatctaaggcatgggtcaaggagctccagcaccgagctgctgacggaatcattattggccttgccggaaa

SEQ ID NO: 1459 - DNA, 670 bp, Artificial
  Synthetic
cccacgcgtccggagagagagagagcttggattttttggaaaggagagagagagagagggtgcacctctttttttcactcttaagtttatttttgctctatttttatatttcctcttcttcgatccgcatcgctctgctctgctctgctcctccctcgtcagaactttgtgcagaacctagggtcctttcggggggaaaggggggggcagagaaggacccatcatggcctacagagcagatgaagagtatgactatctattcaagcttgtgctcattggagactctggagtgggcaagtcaaacctcctctctagattcactcggaacgaattcagtctcgattccaaatcgactattggtgttgagtttgccacgcgtagtctaaacgtcgacgggaagatgatcaaagcccaaatttgggacaccgccggccaagaaaggtatagagccatcacaagtgcatactatcggggcgcagttggcgcattgcttgtgtttgatgtgactaggcatgtcaccttcgagaatgtcgagaggtggttaaaagagcttaaagatcacactgacgcgaatgcggttgtcatgcttgttgggaacaagagcgatctccgacaccttcgggcggtttcaacggaggacggccaagccttctccgagagagagggcctc

SEQ ID NO: 1460 - DNA, 717 bp, Artificial
  Synthetic
agaatgaacctgtttgcgaatccacgaagaaagaagggaaagcggtgccatcgcgggcaggagcagggccagatctgagctgcgccgccatcgatcgacgacccaatccactgccgcagctaaggcgccgcgagatccggaggtcttttgcagggatttcggggattttcgctggtttttcttgatctcttcctcggttctgcgaagaagacgcatcggcagcaatgaatcccgagtatgactatctcttcaaactcctcctaattggcgactctggcgtcgggaaatcgtgcctgctgctacgattcgcggatgattcgtaccttgagagctacatcagcaccatcggggtggacttcaaaatccgaacagtggagctggaagggaagactatcaagctccaaatctgggacactgctgggcaagagcgcttcaggactatcacgagcagttactatcgtggagctcatggcataatcgtcgtgtacgacgtgactgaccaggaaagcttcaacaacgtcaagcagtggctcaacgagattgatcgctacgcgagcgagaatgtgaacaagctcctcgtcgggaacaagtcggatctcactgccaagaaggtggtcgacactcagactgccaaggcttttgcagacgagataggaatcccgtttctagaaaccagtgccaagaacgcgaccaacgtagagcaggcattcatgacca

SEQ ID NO: 1461 - DNA, 689 bp, Artificial
  Synthetic
gagcaaggcctccagaggagagagatatatagtagagagagcgctggtgtgattagatcgccatagccggatcgagtgattgggatgaggaattcatagtttttcttccgggagagcaggttttggcagcgcaatgaagcctggaggatctcctttcaaagttgttcttctgggagacggtagagtcgggaagacttctctcgtcctgcggtacgtgaataatcacttctccgatagtcaaagtgctacgatacaggcttcctacttgaccaagcgcttgagcgtcgatggcactgtggcaacgctatcaatatgggatacagcaggccaggaacgcttccatgcattaggtccgatctactacagggacgctgatgctgcattgcttgtctatgacattatggataaagatagctttactcgtgtgaagaattgggtaaaggagctgcggaagatggcatccaacaagcacatcgtcctgacgatcgctggaaacaagagtgatatggacaagctgcggcaagttgatctccaggactctgagagatacgctgcgtcgattggagcaaaccatttcgtcacctctgcgaagctaaacagtgggatagacgacgctttcatggacatagctacacgttgcatggaacagagaagaaaggctgctgcggactctagcaatggcagcgtgc

SEQ ID NO: 1462 - DNA, 744 bp, Artificial
  Synthetic
gtcaattaggtcttttggatcagggagctcgtccgcgatgtcgtatgcctatctcttcaagtacatcatcatcggcgacacgggtgtagggaaatcgtgcctgctgctccagttcacggacaagcgattccagccggtccacgacttgacgattggcgtcgagtttggggcgcggatgatcacaatcgataacaagcccatcaagctccaaatctgggacacagcaggccaagagtctttcagatcgatcacgaggtcgtactaccgcggtgccgccggtgccttgcttgtgtacgacattaccaggcgagagactttcagtcatctggcaagctggctggacgacgctcggcagcacgcgaactccaacatgacgatcatgctcattggtaacaaggccgatctggctcacaggcgagcagtgagcacggaagaaggcgagcaattcgccaaggaacacgggctcatcttcatggagacgtcggccaagaccgctcaaaacgtcgaggaggctttcattaacacagcatcgaagatccaccagaagattgaagaaggcgtgttcgacgtttcaaacgaggcgtcgggaatcaagatcggagttctaccaaataatccccacagaggtgattacccgggtcctcaaggtggtggctgctgcagctagaaggcgggtataagttctcattaaaaaatgatttaccatgtcgtgaataattttccctcctgtacaaagctatcgtg

SEQ ID NO: 1463 - DNA, 723 bp, Artificial
  Synthetic
ctcagtcgtgtcttgtcacttaattatctcgaccacgcgtcgggtggatctgggagatctagctcgcgaattggtcgcgcgatccgcgtagatagatctggagctgctccttggatgtggaatgccgtggtccaagcttttggggaataggtcgtgagcggcagcgcggcaaaataggtcttgatcgagagtgatttgcgagaaatgggtgtgccaaccgcgacggtgtcgccgctcgccaagtacaagcttgtgttcttgggcgatcaatcggtggggaagacgagcatcatcacgcgtttcatgtatgataagtttgacaacacgtaccaggcaaccattgggatcgacttcttgtcgaagaccatgtacctggaagatcgcactgttcgcttacagctctgggatactgctggccaggaacgttttcgcagcctaattcccagctacatacgggattcgtccgtggcggtggtcgtgtacgatgttgcgaatcgccagtcgttcctaaacacggccagatgggtggaagaagtccgcaccgagcgtggtagcgatgtgatcatcgttctcgtcgggaacaagaccgacttggttgacaaaaggcaagtctcgatcgaggagggggatgccaaagcccgggaatttggagtcatgtacatcgaaaccagtgccaaggccggattcaacatcaaggctctcttcagaaaaatcgctgccgca

SEQ ID NO: 1464 - DNA, 700 bp, Artificial
  Synthetic
ggcaacacgaggaggtcgtagggtttgcgggagagctctcgccgaaggcctgatctgtgctgggatctacaccaggagctcaagcatggcatccaggaagcgaactctcctcaaggcgatcattctcggcgacagcggcgtcggcaagacatcgctcatgaatcaatacgtgaacaagaaatttagcaaccagtacaaggcgaccattggagctgattttctcaccaaggaagtccaagtggaggataggctagtgacgatgcagatatgggatacagccggtcaggagcgattccaaagccttggtgtggccttctatcgaggggctgattgctgtgtgttggtatacgacgtgaatgtgatgaagtcgttcgataatctggacaactggcgcgacgagtttcttatccaggcaagtccttctgatccagagaacttcccttttattgttctcggcaacaaggtcgatgtagacggggggaacagcagagtggtatccgagaagaaagccaaggcctggtgcgcgtcgaagggaaacattccatactttgagacgtctgccaaagaagactacaacgttgaggctgcttttcaatgtatagcgaagaatgccttgaggagtgaacccgaagaagacttctaccttccggacacgaatgacctcgcaaacaacaacagagtgacgagatcatctgggtgt

SEQ ID NO: 1465 - DNA, 604 bp, Artificial
  Synthetic
aaaaagagaaccatgctgaaggtcgtcatcctcggcgactccggcgttggtaagtcgtcgttgatgcaacagtacgtcaacaacaagttcagcacacaatacaaggccacgatcggagccgactttctcaacaaagagctgactctcgagggccgaaaagtcaacatgcaaatctgggacacggccggtcaggaacggttccaatccctcggtctggctttctaccgaggcgccgactgttgcgttctggtctacgatgtcaacaactccaagagttttgatgccctgactctgtggcgagatgagttccttctccttgccaacccccgagacccagaaaactttccttttgtggtgatcggtaacaaggtggatgtggaggagagcaagcgggcagtttccgccaagcgagcccaggccttctgcaaggcaaccggcaacattccctattttgagaccagtgccaaggaggacactggtgtagaccaggctttcgagaccgttgctcgaaacgccatggcacaggtggactcagaggactacacggacgatttcgccgacatcatcaacatccatctggataatgagcagtccaactgtgctt

SEQ ID NO: 1466 - DNA, 263 bp, Artificial
  Synthetic
ggatcgagcagagggggacggactcttcctggatacgaggtcatggcgaacggcttcgtggatttcaatcagaagatcgactatgtcttcaaggtggtgctgattggggactcggcggtggggaagtcacagctgcttgccaggttctccaggaacgagttcactctggaatccaaggcaaccatcggcgtcgagtttcagacccggaccatggtggtggatcacaagaacgatcaaggcacagatctgggacaccgccggtc

SEQ ID NO: 1467 - DNA, 636 bp, Artificial
  Synthetic
gagagtgctctcaagcaaaggatttctctagagagagagagagcgagagagtgtgtctgtgtgagtgtgagaaagagagagagaaatagagatggcaaggagaccggacgaggagtacgattacttgttcaagatagtgttaatcggagattcaggagtaggcaaatccaacttgctctccagattcactagaaatgagttttgcttggagtccaaatctactatcggcgttgaattcgccactcgtactctccaggttgagggaaggatcattaagtctcagatctgggacactgctggacaggagagatatagagccattacaagtgcttactatagaggtgcacttggagctcttctggtatacgatgtgacaaaacctatgtcctttgaaaatgtcagccgatggttaaaggaactgagggatcatgcagactccaacattgtgattatgctcattggaaacaagactgatctgaagcatctccgagcagttcctacagaggatgctcagggctatgctgaaagagaagggcttctttcattgaaacatctgctttggaggcaacgaacgtagaaaaagctttccagatgaatctttcagaaatctatcggataatcagtaagaagtcactt

SEQ ID NO: 1468 - DNA, 660 bp, Artificial
  Synthetic
accttgctctccgtcattttccggcgacgatccctttttccgctatttccggccgtaaggaacagaaacatccccgttcccttcgccctttggatcagtcagcttcgcaaaatcatgaatcccgaatatgactacttgttcaaacttttgttaataggagattcaggtgttggaaagtcatgtcttctcctgagatttgctgatgattcttatttggacagctatatcagcacaattggtgttgactttaaaatacgtacagtggagcaagatgggaagactattaaacttcaaatttgggacactgccggacaagaacgtttcaggacaattacaagtagttactaccgtggagcacatggcattataataacttatgatataactgatcaagaaagcttcaacaatgttaagcaatggttgagtgaaattgatcgctatgcaagcgaaaacgtaaacaagcttctggttggaaataagtgtgacctaactgacaaccgagctgtgtcatatgatacagcaaaggcgtttgctgatgaaatcggcatcccgtttatggagactagtgcaaagagtgccactaatgttgagcaagcgttcatggcaatggcagctgaaataaagaataggatggcgagccagccgacatcaaacaatgca

SEQ ID NO: 1469 - DNA, 681 bp, Artificial
  Synthetic
gttggaaagtcatgtcttctcctgagatttgctgatgattcttatttggacagttacatcagcacaattggtgttgacttcaaaatacgcactgtggagcaagatgggaagacaatgaaacttcaaatttgggacactgctggacaagaacgcttcaggacgattaccagtagttactaccgtggggcacatggcatcattatagtttatgatgtaactgaccaagaaagctttaacaatgttaagcaatggttgagtgagattgatcgttatgcaagtgacaatgtaaacaagcttctggttgggaataagtgtgacctggctgacaaccgtgctgtgtcttatgatacagcaaaggcttttgctgatgaaattggtattccattcatggagactagtgcaaagaatgccacttatgttgagcaggccttcatggcaatggcagctgacataaagaataggatggcaagccagccagcatcgaataatgcaaagcctccaacagtccagatacgaggtcgacctgtttcccagaagagtggttgctgttctagttagaatcacttttcaggccttctcctggttgtattgtgccagatatattctttttaatctgccagtattctggtggcctgtacaaatcataagggttactccttaagatttttctttcctctttga

SEQ ID NO: 1470 - DNA, 730 bp, Artificial
  Synthetic
cccaactctctctctctctagatcaccatttccactttctgcctcttcccccgaagactcttacacttttcacaacttcaaaaatggattcatcagatgatgaaagtggtgaggaatatcttttcaagattgtaataattggtgattcagcagttggaaaatcaaatttgttaacacgttatgcaagaaatgaattcaacttgcattcaaaggcaacaattggagttgagtttcagacccaaactcttgaaattgacggtaaagaagtaaaagctcagatttgggatactgctggtcaagaaagatttagagctgttacttctgcttattatcgtggtgcttttggtgctcttgttgtttatgatattactagacgtaccacttttgatagcatccctcgttggcttgatgagatcaaaacgcattctgataccacggttgcaaggatgctcgtgggaaataaatgtgatttggataacataagagctgtgagcgtagaagaaggcaaaagcttggcagaatcggaaggaatgttcttcatggagacatctgccctcgatgcaacaaacgtaaacaaggctttcgagatggtgattcgagagatctacaatagtgttagcagaaaggttttgaattctgattcttataaagctgaattgtctgtcaacagagttagcctcgtcgataatggtaccgatggatcaaaacaaaatcaaggctattcttgttg

SEQ ID NO: 1471 - DNA, 978 bp, Artificial
  Synthetic
tgcaaagaactcgcccgcagctgagaggggggaataatccataatccgccagcccacgcacatcgccaggcaaatctgcactcttctgcacctccaagaggagtcgcttttgctgcatctccaaagtcgcaagcagacgccgccgaaacgagccggtaaaagatggcggaagctcccaaacccagcagcagcgtcaagctggtgctcctcggtgaagccgcagtcggaaagtcatccctcgtcttgcgattcgtcaacaacgacttccaagagaacaaggagccgactattggtgcggcgttcctgacgcaaaaatgcaacctggccacccgaaccatcaagtttgagatttgggataccgctggtcaagagcgatttgcctctctggcgcccatgtactacagaaacgcccaggccgcccttgtcgtctacgacatcaccaagcccacatccctcgtcaaggcccgacactgggtcgccgagctccaacgacaagcctcacccggtatcgtcatcgccctggtaggaaacaagctagatttggctggcgaatcgaatggtgcaagcgaggaagccgagggcggggaagacggcgatgcccgcaaagtgtcaacagaagaagcccagtcgtatgccgaagaggagagtctgttgtttttcgagacgagtgcaaagacgggccacaacgttaccgaagtcttcacagctattgcaaatgcgatccccgagacgtctctcaagagtgctaggggagccggcgcagcgggcacggccaaccgggctggagacgagcagagagtgaacctatcaggaccaagggatgccggagcaaaggacggatgtgcctgttagatgggagatatttgaattgttatacaaggtacaagcaccatgttgtcggttgctaccgctgctgcgctacccgtcagatgaggtcggatttgttatggcatgtcattcgggagtcagagtcttgcg

SEQ ID NO: 1472 - DNA, 698 bp, Artificial
  Synthetic
cacaaccacacatctcagcgtcacagcttcccttgtctgcacagcatcaaaccaccttttctcacctgcgcgcatcgactcgttctgctgctaccatggccaacgacgaatatgatgtaggttccgcccccttctcgcactgcaacgaaatgaacacctggcggaacgctaacggcgatgcttcaacccccactagttcctcttcaaagttgtcttgattggtgactctggagtcggaaagtccaatcttctcagccgattcactcgcaacgaattcaacctcgactccaagtcaactatcggtgtcgagtttgccactagatcgatccaggtcgactccaagaccatcaaggcgcagatttgggatacagccggtcaggagcgttaccgtgccattacttccgcatactaccgtggtgcagtcggcgccctcctcgtctatgacatcagcaagcaccaaacctacgagaacgtcacgagatggctaaaggagcttcgggaccatgccgatgcgaacattgtcatcatgctggttggcaacaagagcgatttgagacacctgagggctgtgcccacggatgaggccaagggctttgctagcgagaaccatctttctttcatcgagacgtccgccctcgacgccagcaacgttgaacttgccttccagaacatccttactgagatctaccgaatcgtat

SEQ ID NO: 1473 - DNA, 551 bp, Artificial
  Synthetic
gtcttcctctctctcccccgtcttcgcctcgcgctcgcgtctccctccctccctccttccgtccagatccgcgtgggctcgaagaagcggcgggcgatccacggcgagcgtcccgcggtcactcccccccgtctccgtccggcatgaatcccgagtacgactaccttttcaaacttctcctcattggtgattctggtgttgggaaatcgtgcttgcttctcagatttgcggatgattcatacctggacagctacatcagcacaattggagttgattttaaaatacggacagtagagcaggatgggaagaccatcaagcttcaaatctgggatactgctggacaagaacgtttcaggacaattacaagcagctattaccggggagctcatggaattattattgtatatgatgtgacagaccaagaaagcttcaacaatgtgaagcagtggttgaatgaaattgatcgttatgcaagtgacaatgttaacaagctcctcgttgggaacaagagcgacctaactgccaacaaagttgtgtcatctgaaacagct

SEQ ID NO: 1474 - DNA, 791 bp, Artificial
  Synthetic
ggcggatcggtgggttgcgggcttgcacgtagtcgaggctcgagaggagggggggatggcggcggcggcggcggcggcggggtacagggcggaggaggagtacgactatctgttcaaggtggtgctgatcggggacagcggcgtggggaagtcgaacctgctgtcgcggttcgcgcgggacgagttcagcctggagaccaggtccaccatcggcgtcgagttcgccaccaagaccgtccgcgtcgacgacaggctcgtcaaggcccagatctgggacaccgccggccaagagaggtaccgcgccatcacgagcgcctactaccgcggcgcggtgggcgcgctggtggtgtacgacgtgacgcgccgcatcacgttcgagaacgcggagcggtggctcaaggagctccgcgaccacacggacgccaacatcgtcgtcatgctcgtgggcaacaaggccgacctgcgccacctccgcgccgtccccgcggaggacgccagggcgttcgccgaggcgcacgggaccttctccatggagacgtcggcgctggaggccaccaacgtggagggcgccttcaccgaggtgctcgcgcagatctaccgcgtcgtcagccggaacgcgctcgacatcggcgacgaccccgccgcgccgccccgggggcggaccatcgacgtcagcgccaaggatgacgccgtcacccccgtgaacagctcagggtgctgctcgtcttgactttgactcgctcaaactcatcgtcgtcgagctatgcaaattgccaccgttcacagctttg

SEQ ID NO: 1475 - DNA, 605 bp, Artificial
  Synthetic
cccccgagcaactcatctcatcttcagagaagcaaagccaacaaaaagaaaaagaattttcaggttttcttctcgctttcaccggagaaggagaaagagaggaaggtgttgatcgaatcctcctccaatcgcgcgcgattcgatccccgttgctggctcgctcgctccgccgatccctcatccgatctgaatccccgatctgatggcggccaaccccggcaacaagatccgcaacgccaagctggttcttcttggagatgtgggcacgggcaagtcgagcctcgttctccggtttgtgaagggccagtttgttgagttccaggagtccaccatcggcgcggccttcttctcgcagaccttggcggttaacgacgagacggtgaagttcgaaatctgggatactgcagggcaggagaggtatcatagcttggctccgatgtactatcgtggtgcggctgccgcaatagttgtctacgacatcacaaatgcggcctctttcacacgtgcaaaaaaatgggttcaagaacttcaagcgcaaggaaacccaaacacgataatggctcttgctggtaacaaggctgatatggtacaggcgaggcaggtgc

SEQ ID NO: 1476 - DNA, 537 bp, Artificial
  Synthetic
aagaattttcaggttttcttctcgctttcaccggagaaggagaaggagaggaaggtgttgatcgaatcctcctccaatcgcgcgcgattcgatccccgttgctggctcgctcgctccgccgatccctcatccgatctgaatccccgatctgatggcggccaaccccggcaacaagatccgcaacgccaagctggttcttcttggagatgtgggcacgggcaagtcgagcctcgttctccggtttgtgaagggccagtttgttgaattccaggagtccaccatcggcgcggccttcttctcgcagaccttggcggttaacgacgagacggtgaagttcgaaatctgggatactgcagggcaggagaggtatcatagcttggctccgatgtactatcgtggtgcggctgccgcaatagttgtctacgacatcacaaatgcggcctctttcacacgtgcaaaaaaatgggttcaagaacttcaagcgcaaggaaacccaaacacgataatggctcttgctggtaacaaggctgatatggt

SEQ ID NO: 1477 - DNA, 663 bp, Artificial
  Synthetic
tcttttatttacagaaaaacagcataagtgttctcctctcacggcctcaaaaactccgaacagtcgaaagaaacacacaaagacaaaatcctccggggaaaaagaatatgagcaacgaatatgattacttgttcaaactattgctaatcggagattcttctgttggcaaatcttgtcttcttctcagattcgctgatgattcgtacgttgaaagttacataagcacaattggggttgatttcaaaattaggaccgtggagctggatggaaagacaatcaagctgcaaatttgggatactgctgggcaggaacggttccggactataacaagcagttactatcgtggagcacatgggattattattgtttatgatgtaactgaaaaggagagcttcgacaatgtcaagcaatggctgagtgaaattgatagatatgcaaatgaaagtgtttgcaagcttctggttggaaacaaatgtgatttggtagaaaataaggttgtggacacacagacagcaaaggcatttgcagatgagttaggtatccctttcattgagacaagtgcaaaagattccattaatgtggagcaggctttcttgacgatggctggagagattaagaaaaaaatgggtagccaacctgctggagcaaagaactcaggtggcg

SEQ ID NO: 1478 - DNA, 404 bp, Artificial
  Synthetic
cgagttggggagaggagagaaaccgagatcgatccgcacccaccgcgacaaacgctctcccctcccctccccctccgcccttcgctcccatccgctccgccccctcgccgcgcagcgccggcggcgagaaggttgagttcgtggggggtgtgaccgaacgatggcgtaccgggcggacgacgactacgactacctcttcaaggtggtgctcatcggggactccggggtcgggaagtcgaacctgctgtcccgcttcacgcgcaacgagttcagcctcgagtccaagtccaccatcggcgtcgagttcgccacccgcagcatgcacgtcgacgacaaggtcgtcaaggcccatatctgggacaccgccgggcaagaaagatatcgagctattacaagcgcatact

SEQ ID NO: 1479 - DNA, 589 bp, Artificial
  Synthetic
gaattctaaatcaattgatttaccgaagaacgtgagaataattttaatttaatcgattcatcaatattttctaagttgtaatatcttcaatggctacaattgggaacaacaatcttaatgcgaaacttgttttgcttggtgatatgggagcaggtaaatcaagtcttgttttgcgattcttcaaaggtcaatttctcgagtttcaggaatcaacaattggagcagcgtttttctcacagacgttggccgtgaatgatgcgactgttaaatttgagatttgggataccgctggtcaggagagatatcataacttggctcctatgtactacacaggagctgctgctgcaataattgtttacgacataactagcacggagtctttcacgcgtgcaaagaagtgggtgcaagaactacagaaacaaggtaatcccaacatggttatggcacttgctggaaataaagccgacttataagaaaaaaggaaagtgacagctgaggaagcacgtgtgtatgctgaatagaatggtcttttcttcatggagacctctgcaaagactgctatcaacgtcaacgacatattctatgaaat

SEQ ID NO: 1480 - DNA, 692 bp, Artificial
  Synthetic
gccattacggccggggaaaggaaaagtaggtaaaccaatggtcagacagcaagatcccagcaaagactagccaagatctgcgtctcctctctctctctctctctctctctctctctaactttcaactgctgattgagtgtacagaagcttagtgttctggtttaaaaaaagatggcgagtgggtatggggatgcgagccagaagatagattatgtattcaaagtggtgttaatcggcgactcagctgtaggcaagtctcagatactggctcgatttgctcgtaatgaatttagcctggattctaaggccacgattggggttgagttcctgacccgaaccctagtcattcaacacaagtctgttaaagctcagatctgggatactgctggtcaagaacgatatagagctgtcacaagtgcatactacaggggcgcagttggagctatgttggtttatgacataacgaaacggcaaacctttgatcacataccccgttggctggaagagttgcgtgcacatgccgataggaatatcgtgatcatgctgatcggaaacaaaacagatcttgaagaccaacgagctgtccctaccgaagatgctaaagaattcgcccagaaagaaagattattcttcttggacacttctgcaatggaagccacacacgtggaggatgcattcttgactgttttgac

SEQ ID NO: 1481 - DNA, 620 bp, Artificial
  Synthetic
gggagagaaaaagtagtgaatcatgccataagcattcacaatacttttactggccgccttctctctctgtatcacattgcactgttacatagtggcactttctttgtgaagtctttttagagagagaaagtacgtattttttttgtatcggaggaacttttggagagagaaagttgagaaaaggagtcgtcggagagttagctgatggcgacgacggggcagagcaatagcagttacgatctgtcatttaagatattgttgatcggagattccggagtaggcaaaagtagcctgctcgttagcttcatttctaatgccgtcgacgatcttgcccctaccattggtgttgattttaagataaagacgctcactgttggtgggaaaagactgaagcttaccatttgggacacagctggacaggagaggttcaggacactgacaagctcctactacagaggtgctcaagggatcattcttgtctatgatgtaacaagaagagagtccttcacaaacttgtctgatgtttgggcaaaagaggtggagttgtacagtaataatcaggattgtgtgaagatgctggttggaaataaagttgacaaagaatctgagagagctgtgac

SEQ ID NO: 1482 - DNA, 595 bp, Artificial
  Synthetic
tctctctctctctcttctctttcgcaaatctgagctggtcatccatggccacccgcaagcgtaccctcctcaaagtcatcatcctcggagatagcggggttggaaagacatctctcatgaatcaatatgtaaacaaaaagtttagcaatcagtacaaggctacaattggtgctgattttctcactaaagaggttcaagttgaatatagacttgtcaccatgcagatttgggatactgctggtcaagagcgctttcaaagccttggagttgctttctaccgtggtgcagactgctgtgttctagtttatgatgtgaatgtcactaagagttttgacaatctagacaattggcgaaatgagtttcttatccaggccaacccttctgatccagagaactttccgtttgtgctgcttggcaataaagttgatatcgacggtggtaatagcagggtggtgtcggaaaagaaagcaaaagcatggtgtgcaaataaaggcaacattccatactttgaaacttctgccaaggaagacataaatgttgacgcagcattccaatgtattgctaaaaatgcattgaagaatgagacagaagagga

SEQ ID NO: 1483 - DNA, 653 bp, Artificial
  Synthetic
tctttttttagcgcgggtttggacgggatctctctcctctttcggcagaagaagaagaagaagaggaggagccatctcgcttccggggatccaagatcaacctttcttcttccaaaatgaatcctgaatatgattatcttttcaagcttctattgatcggggattctggtgttggcaagtcttcgcttcttctgcgatttgctgatgacacctatgtagagagctacataagcactattggggttgactttaaaattcgaactgtggaacttgatgggaagacaatcaagcttcaaatttgggatactgctggacaagagaggttcagaacaatcacaagtagctattaccgcggagcacatgggatcattattgtctatgatgtgactgatgaggagagcttcaacaatgtgaaacaatggttgaatgaaattgagagatatgcaggcgacaatgtgaataaacttcttgtgggtaataaatgtgacctcacagaaaagaaggtggttgaataccagactgtgaagtcatttgctgatgcaatgggaatccctttcctggagacaagtgccaagagtgcaactaatgtggagcaggcttttatgacaatgactgccgaaattaagaacaggatggtatctcagccagccatg

SEQ ID NO: 1484 - DNA, 640 bp, Artificial
  Synthetic
tatttgaaagtagagagagacagagagattccgatggcaggtgcacccggctctgccagtctccaagccaaattggtgcttctcggggatatgggagcaggaaaatccagcttggttttgcggtttgtgaaagatcagtttcacgagtatcaggagtcaacaattggtgcggctttcttttcacaaaccattgttgtgaacaacacaacagtgaaatttgaaatttgggacacagcaggtcaagaaaggtatcacagtttggctcctatgtactaccgtggggctgctgcagctatcatagtatttgacattacaaatcctgattcatttaatcgagcaaaaaagtgggtacaagagcttcagggacaaggaaatctgaatttggtcatggcacttgcaggaaacaaatctgatttagcatccaaaagaaaaattgaagcagaggaagctcaatcctacgctgatgaaaatggattgtttttaatggaaacatcagcgaagactgcacagaatgttagtgaaatttttcaagagatcgcaaagagactacctagagctcaatctgctcaaaatcctgccggggtttcacttactgataggcctgtggacagagcatcaagtctctcctcatgttgctctt

SEQ ID NO: 1485 - DNA, 636 bp, Artificial
  Synthetic
ctttttttctcttcctcaattttctctcttctctctctttccgccgattccagatctcattttcgagagagtgaagaagaagaagagaaccagaattgaataaaatggcggcagtatcgccattagcaaaatacaagttggtttttttgggagatcaatctgttggaaaaactagcatcattactcgcttcatgtacgataaattcgacaccacctaccaggctacaattggtatcgattttttgtcgaagacaatgtaccttgaagatcgaacagttcgcttgcagctctgggatactgctggtcaggagagatttaggagtcttattccgagctacatcagagattcttctgttgctgtaattgtctatgatgttgccaaccgccaatcatttctaaacacttcaaagtggattgaggaagtacgtactgaacggggcagtgatgtcataatcgttcttgttgggaacaaaactgatcttgttgataaaaggcaagtatccatcgaagaaggcgaaaccaaggctcgtgaatttaacgtaatgttcatagaaaccagtgctaaagctggattcaatatcaagcctctgttccgaaagattgctgctgctttaccgggaatggaagccctttcgt

SEQ ID NO: 1486 - DNA, 705 bp, Artificial
  Synthetic
accctagttcgaggtctctcagagcagtgtgctcgcgtgtgcccaccacgagcctgtagcgattccctcagcagcagcagcgatggccatgtctgcgcacgcctcccaggcggcagtcattgcagcaaccgccaaagcagtgccatcagcatcagcttaccccgcctctactgccacggtatcccttcgccaatcctcgatgcgcggcatgaagcttgttaccccttctctcttgtcgttgtcttcttcctctcctcgcatccgcatggcagcagctgatgctcctgctgcgccagcagaggaggcacctgctgggttcaccccccccgagctcaaagccgacaccccatcccccatcttcggcggtagcactgggggcctcctccgcaaggcgcaggtggaggagttctacgtcatcacctgggaatccccaaaggagcagatcttcgagatgcccacggggggcgctgccatcatgcggcagggcccgaacctcctgaagctggctcgcaaggagcagtgtctcgcactgggatccaggctgcggtccaagttcaagatccagtatcagttctaccgtgtgttcccgaatggggaggttcaatacctgcacccaaaggatggcgtgtacccggagaaggtgaatgctggcaggaagggcgtcggggtgaacttacggtcgatcggcaagaacaagaatccggt

SEQ ID NO: 1487 - DNA, 679 bp, Artificial
  Synthetic
  misc_feature (3)..(3): The residue at this position can be any nucleotide.
aacagagaaaaaaaaaaacaatggcaactcaagccgccgggatcttcaactccgccataacaaccgccgcaacctccggcgtcaagaaactccactttttctcaacaacccaccgtcccaaatccctctccttcaccaaaaccgcaatccgcgccgagaaaacagattcctccgccgccgctgctgcagcccccgccacgaaagaagctcccgtgggattcacgccaccgcagctagacccaaacacaccgtctccgatcttcgctggaagcaccggtggtcttctacgtaaagcgcaagtggaagagttctacgttatcacgtggaactcaccgaaagaacagatctttgagatgccgacaggaggagcagcgatcatgagagaaggtccgaatcttctgaagctagcgaggaaagagcagtgtttagctttggggacaaggcttagatccaagtacaagatcacttaccagttttacagagtgtttcctaacggtgaggttcaatatcttcatcctaaagatggtgtttatccagagaaggcgaatccaggaagagaaggtgttggtctcaacatgagatctattgggaaaaatgttagtcccattgaagttaagtttactggcaaacaaagttatgatttgtaagatctgtaaactaaaaaaaccaaaaactatgt

SEQ ID NO: 1488 - DNA, 728 bp, Artificial
  Synthetic
ggttgtttctcaggcccagcatttgatacatcaaagatgcaggccttggcaatgcaagcgtctccaatgagcctgcgctccacgagcagcgccggcagcagcaccagcagcttcttccaaggtcagtccaagatctccatggcggcggctcctgcgcgagtgagcatgatggcgacggcagataaggcagataaggcagataaggcagctaaggcagataaggcagataaggcagctaaggcagataaggcagataaagcagcacctgcacccgcgggatttaccccaccagagctcaaggccgataccccgtccccaatctttggtggcagcacgggcggactgctgcgcaaggcacagatcgaggagttctacgtcatcacctgggaatcacccaaggagcagatatttgagatgccaaccggaggtgctgcaatcatgcgctccggcccgaacttgctcaagctggctcgtaaggagcagtgcatggcgctgggcacgcagctgcgctccaagctcaagatcaactaccagttctatagggtgttccccaacggtgaggtgcaatacttgcatcccaaggacggagtctaccccgagaaggttaaccccgggcggaagggcgtgggtgtcactctcaggtccattggcaagaattgcaaccccgtcgatctcaagttcacaggcaaggctgcatatgatgtgtaacgcttttgcgcctttggtga

SEQ ID NO: 1489 - DNA, 671 bp, Artificial
  Synthetic
actcgaatcgaatccaccacacggtaccctcctctctcctcctccgaccaccatggccatggccacgcaagcctccgccgccaagtgccacctcctcgccgcggcggcgacggaggagaagaagccagcccccgcggggttcgtgccgccgcagctggaccccaacacgccgtccccgatcttcggcgggagcacggggggactcctccggaaggcgcaggtggaggagttctacgtcatcacatggacgtcgcccaaggagcaggtgttcgagatgcccacgggcggcgccgccatcatgcgcgagggccccaacctgctgaagctggccaggaaggagcagtgcctggccctgggcaccaggctccgctccaagtacaagatcaactaccagttctaccgcgtcttccccaatggcgaggtgcagtacctccaccccaaggacggcgtctacccggagaaggtcaacgccggcaggcagggcgtcggccagaacttccgcagcatcggcaagaacgtcagccccatcgaggtcaagttcaccggcaagaacgtcttcgacatctagacttcttcttcttcttcttcttctctcataatcgacctattaattacttgtgttttgggtggatggacatgtaattttaatcatctgtcaggctgctctccaa

SEQ ID NO: 1490 - DNA, 887 bp, Artificial
  Synthetic
ccccccgatctctctcctccacaccacaccactcgaatcgaatccaccacacggtaccctcctctctcctcctccgaccaccatggccatggccacgcaagcctccgccgccaagtgccacctcctcgccgcctgggcaccggcgaagccgcgctcatccaccctctccatgcccacctcgagggcacccacctccctcagagcggcggcggaggatcagcccgccgcggcggcgacggaggagaagaagccagcccccgcggggttcgtgccgccgcagctggaccccaacacgccgtccccgatcttcggcgggagcacggggggactcctccggaaggcgcaggtggaggagttctacgtcatcacatggacgtcgcccaaggagcaggtgttcgagatgcccacgggcggcgccgccatcatgcgcgagggccccaacctgctgaagctggccaggaaggagcagtgcctggccctgggcaccaggctccgctccaagtacaagatcaactaccagttctaccgcgtcttccccaatggcgaggtgcagtacctccaccccaaggacggcgtctacccggagaaggtcaacgccggcaggcagggcgtcggccagaacttccgcagcatcggcaagaacgtcagccccatcgaggtcaagttcaccggcaagaacgtcttcgacatctagacttcttcttcttcttcttcttctctcataatcgacctattaattacttgtgttttgggtggatggacatgtaattttaatcatctgtcaggctgctcttcagttattgatgatggtgtaatcgatcgatggtgggatataatctcttcttataatattgtagtatatgtttggtgaattttgatgcgtgttc

SEQ ID NO: 1491 - DNA, 424 bp, Artificial
  Synthetic
cccacgcgtccgatccatttactccacagagaaagattcagagaaaacagaagaaactatggcaactcaagccgccggaatcttcagccccgccataacaaccactacttccgccgtcaagaaactccacctcttctcatcaagccaccgtcccaagtctctctccttcaccaaaaccgccatccgcgccgagaaaacagagtcctcctctgctgccccagccgtgaaagaagctccagttggattcactcccccgcagctagacccaaacacaccatcaccaatcttcgccggaagcacaggaggtctcctccgtaaagcacaagtagaggaattttacgtgatcacatggaactcaccgaaagaacaaatctttgagatgccaacaggaggagctgcgataatgagagaaggaccgaatcta

SEQ ID NO: 1492 - DNA, 775 bp, Artificial
  Synthetic
tttttttttttggggggaaattatacagtaatccacatgtttaatggtacctttggaacaggaaaatacaaattaagttcaaacaataatttcattacataaccacacaacctactgcagctcgaggaaatcaactaccccttgaatattccatggctatggcaactcaagcagctctttttaccccaactctttccacctcaaaatcaagcaatttagcatggaaacaatcctcaactgtgtcattcgccagccctaaaccattcaactttgctgcaccacaacgttccattaaggcctcagctgctgaaggaaagacagaagctccagcgaaagaagccccagcaggtttcaccccaccagaattggacccaaacacaccatctccaatattcggaggtagtactggtggattgttgcgtaaagctcaagtagaggagttttacgtgatcacttgggattctcctaaagaacaagtatttgaaatgccaactggaggtgcagctatcatgagacaaggacctaacttgcttaagttggcaaggaaagaacagtgtttagctcttggaaccagattgagatccaagtacaagatcaagtaccagttttacagggttttcccaaatggtgaagttcaatatcttcatcctaaagatggtgtgtacccagagaaggtgaacccaggacgtcaaggagtcggacaaaacttcaggtctatcggaaagaatgtcagccctattgaagttaagttcactggaaaacaagcatatgattt

SEQ ID NO: 1493 - DNA, 809 bp, Artificial
  Synthetic
attctgcacaaatacatctccatttcctccacttttgtaagccaataattctacaatggccatggcaactcaagcttctctcttcactccagctctctctgcctcaaaatcttcagccccatggaaacaatcccttgcttccttctctcctaagcaactcaaatccactgcttccactccccgtcccattagagccatggccgaagaagccgccgccgccgccacaacaaaagcagaggctccagtgggctttaccccaccacaattggacccaaacacaccttccccaatcttcggtggcagcaccggcgggcttctccgcaaggcccaagttgaggagttttacgtaattacttgggaatcacctaaagaacagatctttgagatgccaactggtggtgcagctattatgagggaaggtgctaatttgctgaaattggcgaggaaagagcagtgtttagcacttggtactaggcttaggtcaaagtacaagattaactacaggttttacagggtgtttcctaatggtgaggttcaatacctgcaccctaaggatggtgtgtacccagaaaaggtgaacgctggccgtgaaggagttggacagaacttcagatccattggtaggaacaagagcccaattgaggtcaagttcactggcaaacaagtgtatgatttgtaagctgattatggtattttgtgccttttcgtgtaatgtgatgaatttgtgattatttagtgcatcatttcatgtaattttatttgccactacaaaatacagcatgggattctattattcctcccgtattatc

SEQ ID NO: 1494 - DNA, 619 bp, Artificial
  Synthetic
aactattattactactactcttcatctctactgattgatagaggaacctcagctatggccatccaggcatcctcccagtcagtcatggcaagagcagtagccccgtccatggcctccaccctccccctctcgcccccctctgtgcgcttgtcggcgtggagtagctccgccgtccatggcatccagctccgcctcccccgccctgcttgccgtgtccgcatggcttctgaaatccctgccccggcacccaaagaagaggagaaagatgaggcgcccaaaggtttcaccccgcctactctcaacccggagacgccctcgccaatcttcgggggtagcacaggtggcctcctccgtaaggcccaagtcgaggaattctacgtgatcacgtgggagtccccgaaagagcagatatttgagatgcccaccggcggcgccgccatcatgagggagggacctaacctcctcaagctcgcgcgcaaggagcaatgccttgcacttggctcccgcctccgatccaagttcaaaatcacctaccaattctaccgcgtcttcccgaatggggaagtgcaatacctccaccccaaggatggtgtctaccccgaaaaggtcaacgctggac

SEQ ID NO: 1495 - DNA, 745 bp, Artificial
  Synthetic
cggaatcgaatccaccacacggtaccctcctctctcctcctccgaccaccatggccatggccacgcaagcctccgccgccaagtgccacctcctcgccgcctgggcaccggcgaagccgcgctcatccaccctctccatgcccacctcgagggcacccacctccctcagagcggcggcggaggatcagcccgccgcggcggcgacggaggagaagaagccagcccccgcggggttcgtgccgccgcagctggaccccaacacgccgtccccgatcttcggcgggagcacggggggactcctccggaaggcgcaggtggaggagttctacgtcatcacatggacgtcgcccaaggagcaggtgttcgagatgcccacgggcggcgccgccatcatgcgcgagggccccaacctgctgaagctggccaggaaggagcagtgcctggccctgggcaccaggctccgctccaagtacaagatcaactaccagttctaccgcgtcttccccaatggcgaggtgcagtacctccaccccaaggacggcgtctacccggagaaggtcaacgccggcaggcagggcgtcggccagaacttccgcagcatcggcaagaacgtcagccccatcgaggtcaagttcaccggcaagaacgtcttcgacatctagacttcttcttcttcttcttctctcataatcgacctattaattacttgtgttttgggtggatggacatgtaattttaatcatct

SEQ ID NO: 1496 - DNA, 484 bp, Artificial
  Synthetic
ctcgagcttgcggccgcatccttctcttcattcattttcttgctcaacttgagttgcttccaacatcttgcaagattgtctttgagttcattcaggtcttgaagaagagcactcttttaagctgtgtgaaacttgcgccgttcctgtgaagaactacttttggcattgcagatttcagagagctgtgatttgtgctatcttaaaaacggacaagttctatgttgtggcggatgagatgagggatgctatctgggttgatgaattttctgaatgcctgtctctggccacggtcagatcagcaggctcgttctgcctcagattctggtggccgccaagagggtttgctctggttcagagactccggccagcacgtctttggtgacttctccatggccgtcgttcaagccaacagcttgctagaggaccagagccagctcgagtctggctctcttagctcccacgactctggtccctttggcacctt

SEQ ID NO: 1497 - DNA, 634 bp, Artificial
  Synthetic
gttcatcaatgaacacctctttcaaaatctcaagaggttgacatctgagcaccaatctatgtctgttgaggtgattaagaaagcatttcaagcaacagaagacggtttcctctcggttgtgactaggcaatggcccacaaaaccacagattgctgcagttggatcatgctgtcttgttggagttatctgcagtggaaccttatatatcgccaaccttggcgactcaagggcagtcttagggagacttgtcaagtctactggagaggttctctcgattcagctctctgcagaacacaatgttagcattgaatctgtaagacaagagttgcaaactttgcatccaaatgactcacaaattgtagttttaaagcacaatgtctggcgcgtgaaggggcttatacagatttcaagatccattggcgatgtatatttaaaaaaagctgaattcaacaaggagccattatatgcaaagtttcgtcttcgagaaccgtttgtcaagcccatattgagctctgatccaacaatttcagtgcaccatctgcaacctgatgaccagtttatcatatttgcatcagatggtctctgggagcatctaactaaccaaggagcagtagacattgtacaaaatcaccca

SEQ ID NO: 1498 - DNA, 607 bp, Artificial
  Synthetic
cacagattgagagcaagcagcgtggcgaggcccaaatcgcgcgattcgatcgaggcaaccctccccaattccctcaaatcccctatccgaaatccgccaattggccgcgtccgccacgccaagagaataaaggaaaacatcggcgtatcaacaagtgaagctgcattttcttagagctcagatgaagcggcctcgaaggcgtctgtggtgggatgactgatgagggatgatagtgacattgatgaacttgttacgggcatgctggagaccatcatccaaccagcatgcccgggcaggctcagatgttgccggcaggcaggatggacttctatggtacaaggacactggtcagcatgtaaatggggaattctctatggctgtggtccaggccaacaacttacttgaggatcagtgccagattgaatcgggtccattgagctttcttgactctggtccatacggaactttcgtcggggtttatgatggacatggtggcccagagacggcttgctatatcaacgatcacctattccaccatctgaaaaggtttgcatctgaacagaattcgatgtctgctgatgtgctgaagaaagcatatgaagctaca

SEQ ID NO: 1499 - DNA, 706 bp, Artificial
  Synthetic
ttggatttggcgtcgccctattttagttttgatctctttttgtggatcgccttctgacggtgcccatcccgtccatcatcagcagatccggaaaaatgatgatcagaagtgtgggccgacggttggctttattttcgcgtgatgcatcgtcctcttcaatccccgggggctcgattgcaagggggatctgctcagctggatgcttggagaacaagaatcacgttttttctggcccggatgttgtcaatggtcatttttcgcgtagcaaagagtttgggccatggattctccaacgagatttttcaacggatgcgttaactcaaggttccgattcagctcttcccccaactttagcggcattgagaaactcatctgcaagcatatcgtacgatgagtcagtacaccagcgctatccaccaggtgaccctggcaagcgcgccttcacttactttgtactgacgggtgggagattcatttatgcgtctgctatacgcttcctaattctgaaggccgttctaagcatgtctgctagcaaggatgttctggccatggcctcattggaagttgatttgtcctcaatcgagctgggctccacagtcactgtgaagtggagggggaagcccgtgttcattcggaggcgcaccgagagcgacatacagctagccaatagtgttagcctaagcgagttgcgggacccacaagaaga

SEQ ID NO: 1500 - DNA, 533 bp, Artificial
  Synthetic
tcgactgaacaatgagcctgcttcgaaccgccgcccaggccgtcaaggcccccaagggctacactcctcttgtggccgcaaaggcctttgctcagacccgatctgtctcttcacagcccattggtggcaagtccacatacaagatccccgacttcactccttacctcaagaaggaccgaaacacagatgccaaccgtctcttctcctacttcatgattggatcgtttggcatgctctccgctgccggcgccaaggccaccgtccaggacttcctttccaacatgtctgcttccgctgacgttctggccatggccaaggtcgaggtcaagctcggtgccattcccctcggtaagaacgtcatcatcaagtggcgaggaaagcccattttcatccgacaccgaacctccgaagagattgaagaggccaacgaggtcaacgttgctaccctgcgagacccccagactgacgacgagcgagtgcagaagcccgagtggctggtcatgatcggagtctgcacccatctgggttgtgtg

SEQ ID NO: 1501 - DNA, 648 bp, Artificial
  Synthetic
agggcattgggtttcttgagggctgctcgggcgccatggctgcgtcactgatccgggatctagggaagaagatagctccgcgcatcgcggcggcagcgtcggcgtcttctttccacacttgctcgtccggcgcctccaggggcgcggcgttgggcgctagcaacgtaatggcgcattgggactgggacagggaagacggcaaaaccaccccatggagccactccactacacgaggatgcgccgtcaccacccggggcgccgatctaagcacacgaaacgaagactcggctttcctccaggctctccgcaaccccacggccaacatcacctacgacgaggaggtggtggagcggttcccgccgggagacccggaccgagcagcattcgtctacttcatcgtcacgggctcccgcttcgcatacgccgccgccatccgcgtcttcatcctccgcatgatcatgaccatgtccgccagcgccgacgtcatggccctctccagcctcgaggttgacctcagcaacgtcgtcgagggggcgaccatcaccgtcaagtggcgaggcaagccggtgttcatccgccgccggacctcagacgaggtggcggaggcaaacagcgtttcggtgaattccctgcgcgatccacagccgg

SEQ ID NO: 1502 - DNA, 540 bp, Artificial
  Synthetic
caaggaaccaagatactggcttggctgaactacctgcaaccgttgctgcactgaagaatcccaacccaaaggtggtgtacgatgagtacaaccatgagaggcatgcacctggggatcccagcaagcgtgcatttgcttactttgttctaagtggtgggagattcatctatgcatcgttgctgcggctcctcgtattgaaattcgtgctgagcatgtctgcaagtaaggacgtgcttgcgcttgcttccctggaggtggatctctcaagcattgagcctggtaccacagtgacggtgaagtggcgtgggaagccagttttcatcagaaggaggacagaggacgacatagcgctggccaatagcgtggacgttgggtccctgcgccatccccagcaggacgcagagcgtgtgaagaacccagagtggctagtggtcattggcgtctgcacccaccttggttgcattcctctccccaatgctggagatttcggaggttggttctgcccgtgccatggctcccactacgacatctctggcagga

SEQ ID NO: 1503 - DNA, 489 bp, Artificial
  Synthetic
ggcgaggccggtgactttggtggctggttctgcccctgccacggctcccactacgacatctctggccggatacgaaagggccccgcgcctctcaacctggagattcccgagtacgacttccccgaggatgacaagcttgtcattggttaaaaatcgcgaatacatgtataaagaatcgggggagacaaaagagagggggggagactgtcctgtcacaaacgatgtaacagtatcagagggggggagtcttgggaactaaaatgggtgaaagatgagacagctcccggacaaaaatacataattcgtctcggaattacaaaaaacatagattctctctgggcggtcaagtctatcggcgggatgggaggttggaatgaagaaatggaagaatggtgtctcatgatgctgggaatgggacacacaaactccttgtttcttagacgtgggccatgtgcagcattgtataaataaaaacgttttactaaaaaa

SEQ ID NO: 1504 - DNA, 601 bp, Artificial
  Synthetic
gtagccctgtgtgcaacggcgcaagtgcttgtacgctttcagctagcgtagccatggcttccagggcattcctcctcctggctctaaatctggtcctcttcttcaccgtggccagcgcctgcggcaagtactgcccgacgccttcgacgccgtcgacgacgccatcgacgccgtcctacaacaccaagtgccccaagaacgcgctcaagttcgcggcgtgcgccgacgtgctgggcctcgtcagcgccgaggtcggccagccgccgtacgagccgtgctgcggcgtcctcggcggcctcgccgaccttgaggccgccgtctgtctctgcaccgccatcaaggccaacgtgctcggcatcaccctcgacatccccgtcaagctcagcctcctcgtcaactactgcggcaagaacgtccctagtggcttcatctgtgcttaagctacgtaacgcgcgtacggtgtaacgacgtgctagctttgcatgcatgcagcacgcatgcacgaacacatcgttcgttcttgagtgcctgcatgcatatcggtcgagtctttacttactctgttattagttctgaatgtagaactgcttcagatatcaat

SEQ ID NO: 1505 - DNA, 635 bp, Artificial
  Synthetic
  misc_feature (244)..(244): The residue at this position can be any nucleotide.
  misc_feature (246)..(246): The residue at this position can be any nucleotide.
  misc_feature (247)..(247): The residue at this position can be any nucleotide.
  misc_feature (290)..(290): The residue at this position can be any nucleotide.
catctccagaagatcaagagctcttaattagctagctagtgattagctgcgcttgtgatcgatcgatctcgggtacgtagcaatggcgtccaaggcgtcgctctgttcctggccgtgaacctcgtcgtgctcggggtggcaagcgcctgcggcggcagcccgtcgtgcccgacgccgacgccgtcgaccccgacattgtcaacgccgacgccgacgccgtcggcgttcgggagggggtggcccncnncgcgacgcgctgaagctgggcgtgtgcgccaacgtgctgggcnctgatcaaggccaaggtgggcgtgcctccggcggagccgtgctgcccgctgctggaggggctcgtcgacctcgaggcggcggtgtgcctctgcacggccatcaggggcaacatcctcggaatcaacctcaacctccccatcgacctcagcctcatcctcaactactgcggcaagaccgtccccaccggcttcaagtgctaagcagcgtgcatatgcaatgcctgcatgggttgatcctacgtacggtgattagttggctttgacgactcttgatttgatttgcttgctgctctgtttatttgctactacgttacgtacgtactttgcatgcaacgcaacgcatga

SEQ ID NO: 1506 - DNA, 462 bp, Artificial
  Synthetic
gctgaagctgggcgtgtgcgccaacgtgctcaacctgctcaagctcaaggtgggggtgccggcgagcgaggagtgctgcccgctgctgggggggctcgtcgacctcgacgccgccgtctgcctctgcaccgccatcaaggccaacgtcctcggcatcaacatcaacgtccccgtcgacctcgtcctcctcctcaactactgccacaagacctgcccttccgacttctcctgcccactcatctgattcttaatcttcattaccaccacaaccctagctacctaattaaggcttaagctttgcatggcttagtctgtgtgttgcagttgtgtcatacatatatacttatctcgatctatcagtgtgattattgatgatcagatctatcatctaatatatgtatcttgttattttaatgcgtactgtcaaataaaagtttcctccagtgtacgtacgttctatct

SEQ ID NO: 1507 - DNA, 572 bp, Artificial
  Synthetic
gtcctttgactgcttttgtccttcccatggccgcctctggaccagcccgcgctcgtgaccacgactacctcatcaagctgctgctcatcggggatagcggtgttggcaagagttgcttgcttctacgattttctgatgatacattcactacaagtttcatcacaaccataggaattgatttcaagataagaaccattgagatggatggaaagagaataaagctccaaatatgggatacagctgggcaagagcgctttaggacaattactacagcatactacagaggcgccatgggtattattcttgtgtatgatgtaacggatgaatcatctttcaacaatattcgcaattggattaggaatatagaacaacatgcttcagataatgtcaacaagatattagtgggtaacaaagctgatatggatgagagcaagcgggctgtgccacatgaacgtggtcaagcacttgccaatgaatataacttgaagttctttgagacaagtgccaaaacaaatatgaatgttgaagaagtctttttttccattgcaagagatatcaagcagcggttatca

SEQ ID NO: 1508 - DNA, 666 bp, Artificial
  Synthetic
aaagaggaaggaaggaaggaaaggatgtccatcgccgccgacctgccgttccctgctatggcgaccgtcgtctgatctacccctttcctttccctcctcgccgatatggcgtcccgcccccgtgcagactatgacttcctcgtcaagctccttctcatcggggacagcggtgttggaaaaagttgccttcttctccgattctctgatgattctttcaccacaagctttattactacaattggaattgatttcaagattagaacggtggagatagatgggaaacggatcaaattgcaaatctgggacacagctgggcaggaacgctttcgaacaataaccacagcatactacaggggtgccatggggattatccttgtgtacgatgttacagacgagtcttcatttaacaacattgggaactggatcaggaacattgagcaacatgcctctgagaatgtcaacaaaatattggtgggcaacaaggctgatatggatgaaagcaagagggctgtttcatttgcaaaaggcaaagctcttgccgatgagtttggtatcaagttttttgaaacgagtgcgaagacaaacatgaatgtggaggcgtcctttgtcacaattgcaagggatatcaaacagcggctttcggagtcagacttcaaaccacagccc

SEQ ID NO: 1509 - DNA, 645 bp, Artificial
  Synthetic
ttttcccctttcagcccaatgttgccgacgactttctgaccttctcaaaaacctctgtgtttctctcacatttctggtgccaatctcttgatatttattggagaagacgatggcagctccaccagcgagggctcgagcagattatgattatcttatcaagctcctcctcattggtgatagcggtgtgggaaagagttgtttgctgctgaggttctcagatggttcctttacaacaagtttcatcaccactattggaattgactttaagataagaacaattgaacttgatggcaagcggattaaattacaaatttgggatacagctggtcaggagcgtttccgcactatcacgacagcatattatcgaggagccatgggtattctgctggtgtacgatgtcacggacgagtcatctttcaataacatcaggaactggattcgcaacatagagcagcatgcttctgacaatgtcaataagattttggttgggaacaaggctgatatggacgaaagcaaaagggctgtgccaacttccaagggtcaagctcttgctgatgaatatggcattaagttcttcgaaacaagtgcaaaagacaaacatgaatgtggaagaagttttcttttcaattgctagggatatcaaac

SEQ ID NO: 1510 - DNA, 818 bp, Artificial
  Synthetic
agggaagatcatcgtgcatcgcgcggaggtctggatcggcagcgctaatggcggcggggagagcgcgggcggactatgactacctcatcaaattgctgctcatcggcgacagcggtaagagaaagaatttcgatccggcgggggaagtctttgtctagcagctagatctctgctcgatctgcacgaaatatcgatgagctgatggatttggtcgccgcatttctctctgcccgcaggtgtggggaagagctgccttttgctgcgcttctcggacgattccttcacgacgagcttcatcacgacgataggcattgacttcaaaatcaggaccgttgacctggatggcaagaggatcaagcttcaaatttgggacaccgctgggcaagaacgcttccggacgatcacaactgcatactaccgaggagctatgggcattcttctcgtctacgatgtgacggatgaatcatcgttcaacaacatccggaactggatcaggaatatcgagcagcacgcgtcggacaatgtgaacaagatcctggtcggcaacaaggccgacatggacgaaagcaagagggccgtatcaacagaaagagggcaagctcttgcgaacgagtttggtatcaagttcttcgaaaccagcgcgaagacgaacatgaacgtggagaacgtcttcttcacaatcgcgggagacatcaagcggagactagcggaaacagactccagacccgagcctcccaggatcaacaacgtaatactagacccgtcgaaggatcagaacaacaacaaagacaagtcatcatgttgcacctgagagcaag

SEQ ID NO: 1511 - DNA, 701 bp, Artificial
  Synthetic
ttatgtggatcgattcgtgagctacttactaggcgagaatcaaatggcactgtcttcctcctccgtcagcggcaacgagtttgatcacctcttcaagatactgctcgtcggggactcgggtgtcggcaagagcagcctgttgctgcgattcaccgccgacactttcgacgatctctcccccacaatcggtgtggatttcaagctcaagcttatgacgctggaaggcaagaggctcaagctcaccatctgggacacagccgggcaggaaaggtttagaacgcttacgagctcgtactaccgaggggcacaaggcgtcattcttgtttacgatgttacaagaagagatacgttcacgaatctctcggaagtttggctcaaggaggtcgagctctactccaccaaccaggactgcgtcaagctcttggtggggaacaaagtcgacagggattccgagcgtgcggtgacgaagcacgaaggcatggctttcgcccggaagtatggctgcctgttcctggagagcagtgccaagacgaagatcaacgtccaacaatgctttgaagagctggtcaggaagattctggaaactcccagcttggtagccgaggccaagtcggtgaagaaaaacatcatcagaccaagcaacgatgaggagccgcctgcagctggcgataactctggtagctgcgcgtgttgatagagag

SEQ ID NO: 1512 - DNA, 624 bp, Artificial
  Synthetic
gaattcaggggcgaatataccaaaaatcaaatggaggcacataacaagaaaataaaatcggttggcggatgcatgggcgtttattccaagcatgatgataaatccaagcatgaagagtatagatatccaaacaattaaatctccatcaataaacaaggaagaggaagaaacagaagcaattacaatggaagtggaaagaagttcacgagaacaaggttcgcaagattggagaaaagagattcacgcatattttgcaaagggggagttgccagggaataaattagaagctcataaagttagaagccgttctacaaattacgagttaagggagggttttctatacaggagatctttcacaggaccatatctcaggtgtataactcgcgaagaaggagaaaagatattaaaaatgttgcatggaggggaagctggaaatcatggtggaggaaggtcattggcatataaagcaaaagttcaagggtattattggccgtatatgcatactgatgcaaaggtattagtaagaagatgcaaagaatgtcaaaagttcgcaaaaagaattcatgcaccaggagctcctttaacatcctcaacaagtggctgtccctttggaaaatgggggct

SEQ ID NO: 1513 - DNA, 380 bp, Artificial
  Synthetic
atttcccactctcacattggaggggacgaggacttcgatccactgagaggaactacagctccggctgtcccgtgatcgcccactatggcgcgaggtttgaagaagcatttgaagcggctcaatgccccccgtcactggatgctcgacaaacttggcggagctttcgcccccaagccatcgtccggcccgcacaaggagagggagtgcctgcccctcgtcgttctcctccggaaccggttgaaatacgccctgacctaccgtgaggtcgtcgccatcgttatgcagcgactcatctccgtcgacgggaaggtccggaccgacaaatgctacccggctggattcatggacgttgtctccattgcccgcaccaatgaaaactt

SEQ ID NO: 1514 - DNA, 776 bp, Artificial
  Synthetic
ccccccccggtcatctcggcggcggcgcggcgcggagcagaggaggacgaagcagcaggcggcggcggcagagcacggcgacctagcccgacctcgcaaccatggcaaggggtttgaagaagcatctgaagaggctcaatgcgcccaagcattggatgctcgacaagcttggtggagcttttgcccccaagccatcttctggtcctcacaagtccagggagtgcctgcctctgatcctcattatcaggaacaggctcaagtatgctctgacataccgtgaggttatttctatcctcatgcagcgccatgtcttggttgatggcaaggtcaggactgacaagacctacccagctggtttcatggatgtcatttccatccccaagactggtgagaactacaggcttctgtacgacaccaagggacgtttccgccttcagtctgtcaaggatgaggatgctaagttcaagctttgcaaggttcggtctgtgcagtttggccagaagggaatcccctacctgaacacctatgatggtcgcaccatccgctaccctgacccgatcatcaaggcaaacgacacaatcaagatcgatctggagaccaacaagattgtcgacttcatcaagtttgatgttggcaatgttgtcatggtgactggaggaaggaacacaggccgtgttggtgtgatcaagaacagggagaagcataaaggcagcttcgagaccatccacgttgaggatgccctgggccaccaattcgccacccgtctgggcaatgtg

SEQ ID NO: 1515 - DNA, 591 bp, Artificial
  Synthetic
gatgggcggacgatccgctatcctgatcctctcatcaaggccaatgacactgtcaagatcgacctagagacagggaaggttgttgacttcatcaaatttgaccttggcaatcttgtcatggttacaggtgggaggaacagagggaggattggagtaatcaagcatcgtgagaagcataaaggaagttttgagattatccacgttcaagattctgtcggccatgaatttgcgaccagattggggaacgtgtttaccattggaaaagggaccaagccttgggtgacactgcccaaaggtaaaggtattaaactttccatcgtcgaggaggcgaggaagagaacagccacgctcaaagctgcctctgcttagagaggatcctttctcatatagcaactgaagtttagatgcgtatggagttttgcattcttgcttggatgcagtttgagtttgcttagtaattagagtctagcggttttcttttatactgtagttgtgcctctgaagttcaccttccggaaacaatgatgggaattttgcaaatttttttcttcattctattctatttggaaaaattgattactctgttttagt

SEQ ID NO: 1516 - DNA, 573 bp, Artificial
  Synthetic
ggggtttgaagaagcatctggggaggctcaatgcccccagccattggatgcttgacaagcttggtggagcatttgcacccaagccttcttctggtccccacaaagctcgggagtgcttgcctttgatccttatcctcaggaacaggttgaagtatgctctgacctaccgtgaggttatttccatcttgatgcagcggcatgttatggttgatggaaaggtcaggactgacaagacttatccggctggattcatggacgttgtgtcaattgcaaagactggggagaatttccgccttctgtatgacaccaagggtcgcttccgtctccacagcatcaaggatgaggacgctaagttcaagctctgcaaggtccggtctgtacagtttggacagaagggtattcctttcctgaacaccaatgacgggcgcacgatccgctacccagacccactcatcaaggccaacgacaccatcaagattgacttggagaccaacaagatcatggacttcatcaagtttgatgttggaaatgtcgtgatggtgaccggtgggaggaacacggggcgcgtcgggg

SEQ ID NO: 1517 - DNA, 601 bp, Artificial
  Synthetic
cccacgcgtccggctgcaaacatggcaagaggattgaagaagcatctaaagaggctcaatgctcctaagcattggatgcttgacaaacttggtggtgccttcgctcccaaaccatcttctggacctcacaagtcgagggagtgtcttcctcttgtcctgatcatcaggaacaggttgaagtatgctttgacttaccgtgaagttatctctatcttgatgcaaaggcatatccaagttgatggcaaagtcaggactgacaagacttaccctgctggtttcatggatgttgtatccatccccaagaccaatgagaacttccgtcttctctacgacaccaagggacgtttccgtctccactccatcaaggatgaggaagcaaagttcaagctttgcaaggttagatctatccagtttggtcagaagggaattccatacctgaacacttatgatggtcgcaccatccgttaccctgacccgctcatcaagccaaatgacaccatcaagctggaccttgaggagaacaagattgttgagttcatcaagtttgacgtgggtaacgttgtgatggtgactggaggcagaaacagagggcgtgtgggtg

SEQ ID NO: 1518 - DNA, 648 bp, Artificial
  Synthetic
acgctgccgaagctggagctggagcaggaggaagaagaaggagaaggaggaggaggaggagcagcagtccagctatggcgcgaggattgaagaagcacttgaagcggctcaatgccccccgccactggatgctcgacaaacttggcggtgccttcgcccccaagccctcagcaggtccccataaagagagggagtgcctgccccttgttgttcttctcaggaacaggttgaaatatgcactcacataccgtgaggttgttgcaattgtcatgcaacgacttgtctccgttgacggaaaggtccgtactgacaaatgttaccctgctggatttatggatgtcgtttcaattgcccgaaccaacgagaatttcagactcttgtatgacagcaaggggaggttcactgtccactctgttggtgtggaagaagccaggtacaagctctgtaaggtgaaagcagtgaggtttggcgataaaggaatccccttcctcactaccaacgatgggcggacgatccgctatcctgatcctctcatcaaggccaatgacactgtcaagatcgacctagagacagggaaggttgttgacttcatcaaatttgaccttggcaatcttgtcatggttacaggtgggaggaacagagggagga

SEQ ID NO: 1519 - DNA, 734 bp, Artificial
  Synthetic
gaccagaccggcaacaacaggcaagatgggcaagggactcaagaagcaccagaagcgcctcagcgcgccttcgcactggctcctcgacaagctgtcgggcacctacgccccccgcccctcggccggtccccacaagctccgcgactgcatgcccctgatcatcttcatccgcaaccgcctcaagtacgccctcaactaccgcgagaccaatttgatcatgatgcagcgcctcgtcaaggttgacggcaaggtccgcaccgacatcggcttccccgccggcttcatggacgtcatcaccatcgagaagaccggcgagaacttccgcctcgtctacgacaccaagggccgcttcaccgtccaccgcatccaggccgaggaggccgagtacaagctgggcaaggtcaagcgcgtccaggtcggccgcggcggagtcccattcttggtcacgcacgatgcgaggaccatccgctaccccgaccctctgatcaaggtcaacgacaccgtcaagatcgatctcgccaccggcaagatcaccgacttcatcaagttcgacaccggcgccatcgccatggtcaccggtggtcgcaacatgggtcgtgtcggcgtcatcacccaccgtgagcgccacgacggtggtttcaacatcgtccacatcaaggacgccatcgacaacaccttcgccacccgtgagagcaacgtcttcgtcatcggctccgagaagcctggatctccct

SEQ ID NO: 1520 - DNA, 695 bp, Artificial
  Synthetic
gttaggtcagtgctgaggatcaggcggcggcgatggcgcggggaccgaagaagcatctcaaggtgctcaatgcgcccaagcattggatgctcagcaagctcggcggtgcctttgctccaaagccatcgtcgggccctcacaaggagagggaatgcctgcctctggtcattcttctgcggaacaggctcaactacgccctgacgtaccgcgaagtcatgtccattgtcatgcagaacctcatctcgattgatggcaaggtccgcacggataagtgtttccctgctggattcatggatgtcgtgactatcggcaaggtcaatgagaactatcgtcttctctatgacaacaagggccggttcactctgcattccatctctgctgaggaggctaagttcaagctctgcaaggtccgtgctgtcaagttcggcgacaagggaattcccttcctcacgacttacgacgggaggaccatccgctacccggacccgctgatcaaggccaacgacaccatcaagatcgaccttgagacggggaagatcaaggagttcatcaagttcgacatcggcaacatcgcgatggtcaccggcgggcgcaacaggggccggattggcaccatccagcaccgtgagaagcacaagggatccttcgacatcatccacgtcaaggacgctgtgggccaggacttcgccacccgc

SEQ ID NO: 1521 - DNA, 680 bp, Artificial
  Synthetic
gggcggacgcgtgggcggacgcgtggggatgaaaatggtgcggggaccgaaaaaacatctcaaggtgctgaatgcaccccgccattggatgctcagcaagctgggcggtgccttcgctccaaagccatcgtcgggtcctcacaaggagagggaatgcatccccctggtaattctcctccggaacaggctcaactatgccttgacgtaccgggaagtcatctctatcgtcatgcaaaacctcatctccatcgatggcaaagttcgcacagaaaaatgctttcccgctggtttcatggatgtggtgactatcgggaaggtgaatgagaactaccgccttctttacgatacaaaaggccggttcactctccagccggtcaccgacgatgaggcaaagtacaagctttgcaaggttcgtgccgtgatgttcggatctaagggaattcctttcctcacgacttacgacgggaggaccatccgctaccccgatcctctgatcaaggcgaacgacaccatcaagatcgacttggagactgggaagatcaaagagttcatcaagttcgaggttggcaacatcgccatggtcacgggtggccgcaacaggggaaggattggaaccgtccagcaccgcgagaagcatatgggaagctttgatataatccacatcaaggacgctgccggcc

SEQ ID NO: 1522 - DNA, 607 bp, Artificial
  Synthetic
cccacgcgtccgggagaatttccgccttctgtatgacaccaagggtcgcttccgtctccacagcatcaaggatgaggacgctaagttcaagctctgcaaggtccggtctgtacagtttggacagaagggtattcctttcctgaacaccaacgacgggcgcacgatccgctacccagacccactcatcaaggccaacgacaccatcaagattgacttggagaccaacaagatcgtggacttcatcaagtttgatgttggaaacatcgtgatggtgaccggtgggaggaacacggggcgcgtcggggtgatcaagagcagggagaagcacaagggcagctttgagaccatccatgtcgaggatgccctcggccaccagttcgcgactcgcatgggcaacgtcttcaccatcggcaaggagaggaagccgtgggtatctctccccaagggcaagggcatcaagctcagcatcattgaggaggcgaggaagcgcaatgccgaggctgccgctgaggcttgatttctgaaaatctccatgaatgaaactgttgatttgagcagtctatttatatagattatttagctcttaagatcatatgtccattggaga

SEQ ID NO: 1523 - DNA, 848 bp, Artificial
  Synthetic
aaaaatggcccgaggacccaagaagcatctcaagcgactcgcagctccctcccactggatgctggacaagctgtccggcacctacgctccccgatcgtctgccggtccccacaagctgcgagagtctctgcctctcgtcatcttcctgcgaaaccgtctcaagtacgccctgaacggccgagaggttaacgccattctcatgcagcgactggtcaaggtcgacggcaaggtccgaaccgactccactttccccgctggcttcatggatgtcatccagctcgagaagaccggcgagaacttccgacttgtctacgacgtcaagggccgatttgccgtccaccgaatcaccgatgaggaggctgcttacaagctcggcaaggtcaagcgagtccaggttggcaagaagggtatcccctacctcgtcacccacgacggccgaaccatccggtaccccgaccctctcatcaaggtcaacgacaccgtcaagatcgacctggccaccggcaagatcacctctttcgtcaagtttgagaacggtaacattgtcatgaccaccggaggtcgaaacatgggccgagtcggcaccatcacccaccgagagcgacatgagggtggcttcgatatcgtccacatcaaggacgctcttgacaaccagtttgttacccgactcactaacgttttcgttatcggtgagggcaacaagtctctcatctctctgcccaagggcaagggtatcaagctctccattgctgaggagcgagatgcccgacgagccaagcaggagtaagttcagattgaacacattgtttagctaaaaaaaagattcatgtatagcatgttgtaaaaaa

SEQ ID NO: 1524 - DNA, 657 bp, Artificial
  Synthetic
gcaccgtcgagaaaacagccagtcgtcaccatggcccgaggaatcaagaagcaccagaagcgccttagcgccccctcccactggctgctggacaagctgtccggtctctatgcccccaagccttctgccggtcctcacaagctccgtgactgcatgcccctgatcgtcttcatccgcaaccgtctcaagtatgccctcaactaccgcgagaccaaggccatcatgatgcagcgcctggtcaaggttgacggcaaggtccgcaccgacatcacctaccccgccggctacatggacgtcatcaccatcgagaagactggcgagaacttccgtctcatctacgacaccaagggccgcttcaccgtccaccgaatccaggccgaggaggccgagtacaagctgggcaaggtcaagcgcgttcagctcggccgtggtggaatcccattcttggtcacgcacgatgcgagaacgtgagttctgtcagacatcattcagccgttggatcaagctttggtcgattcgggaaaaaaggaaggagaaaaattcaaaaaattcacctcccttgatttgttttcatcttttctcattttccctcttctcacagagagagaaaaaaaggaagaagaaacagagacgacgacgacggaagctttatttgac

SEQ ID NO: 1525 - DNA, 696 bp, Artificial
  Synthetic
cccacgcgtccgacgcccaacctttccgtcgttttcatcaccgtcgagaaaacagccagtcgtcaccatggcccgaggaatcaagaagcaccagaagcgccttagcgccccctcccactggctgctggacaagctgtccggtctctatgcccccaagccttctgccggtcctcacaagctccgtgactgcatgcccctgatcgtcttcatccgcaaccgtctcaagtatgccctcaactaccgcgagaccaaggccatcatgatgcagcgcctggtcaaggttgacggcaaggtccgcaccgacatcacctaccccgccggctacatggacgtcatcaccatcgagaagactggcgagaacttccgtctcatctacgacaccaagggccgcttcaccgtccaccgaatccaggccgaggaggccgagtacaagctgggcaaggtcaagcgcgttcagctcggccgtggtggaatcccattcttggtcacgcacgatgcgagaaccatccgttaccctgaccccctgatcaaggtcaacgacaccgtcaagattgacctcgccaccggcaagatcaccgacttcatcaagttcgacactggcgccgtcgccatggtcactggtggtcgtaacatgggccgtgttggtgtcatcacccaccgtgagcgtcacgacggaggcttcaacattgtccacat

SEQ ID NO: 1526 - DNA, 617 bp, Artificial
  Synthetic
gcgacgcatacggacggcgtggtggtctccccctccggcgacgtagctcgagctcgcaaccatggcgaggggattgaagaagcatctcaagaggctcaatgcgcccaagcactggatgctcgacaagctcggcggagcttttgcccccaagccatcgtctggacctcacaagtccagggagtgcctgcccctgatcctcatcatcaggaacaggttgaagtatgcgctgacataccgtgaggttatctctatcctgatgcagcggcatgtcttggttgatgggaaggtcaggactgacaagacctaccctgctggtttcatggatgtgatttccattccaaagactggtgagaactacaggcttctctatgacaccaagggtcgcttccgccttcagtccgtcaaggatgaggatgccaagttcaagctttgcaaagttcggtctgtccagtttggacagaagggcattccctatctgaacacctatgatggacgcaccatccgctacccggaccctttgattaaggctaacgacacaatcaagattgatcttgagaccaacaagattgttgacttcatcaagtttgatgtgggcaatgtcgttatggtcacaggag

SEQ ID NO: 1527 - DNA, 389 bp, Artificial
  Synthetic
gcggcgcggagcagaggaggacgaagcagcaggcggcggcggcagagcacggcgacctagcccgacctcgcaaccatggcaaggggtttgaagaagcatctgaagaggctcaatgcgcccaagcattggatgctcgacaagcttggtggagcttttgcccccaagccatcttctggtcctcacaagtccagggagtgcctgcctctgatcctcattatcaggaacaggctcaagtatgctctgacataccgtgaggttatttctatcctcatgcagcgccatgtcttggttgatggcaaggtcaggactgacaagacctacccagctggtttcatggatgtcatttccatccccaagactggtgagaactacaggcttctgtacgacac

SEQ ID NO: 1528 - DNA, 645 bp, Artificial
  Synthetic
ccccccccgatccctctctcctctttggcggcggcggcggaagagagcgacgcagacggacggcgtggtggtctccccctccggcgacgtagctcgagctcgcaaccatggcgaggggattgaagaagcatctcaagaggctcaatgcgcccaagcactggatgctcgacaagctcggcggagcttttgcccccaagccatcgtctggacctcacaagtccagggaatgcctgcccctgatcctcatcatcaggaacaggttgaagtatgcgctgacataccgtgaggttatctctatcctgatgcagcggcatgtcttggttgatgggaaggtcaggactgacaagacctaccctgctggtttcatggatgtgatttccattccaaagactggtgagaactacaggcttctctatgacaccaagggtcgcttccgccttcagtccgtcaaggatgaggatgccaagttcaagctttgcaaagttcggtctgtccagtttggacagaagggcattccctatctgaacacctatgatggacgcaccatccgctacccggaccctttgattaaggctaacgacacaatcaagattgatcttgagaccaacaagattgttgacttcatcaagtttgatgtgggcaatg

SEQ ID NO: 1529 - DNA, 408 bp, Artificial
  Synthetic
cgctccaagttgatggcaaagtcaggactgacaagacttaccctgctggtttcatggatgttgtatccatccccaagaccaatgagaacttccgtcttctctacgacaccaagggacgtttccgtctccactccatcaaggatgaggaagcaaagttcaagctttgcaaggttagatctatccagtttggtcagaagggaattccatacctgaacacttatgatggtcgcaccatccgttaccctgacccgctcatcaagccaaatgacaccatcaagctggaccttgaggagaacaagattgttgagttcatcaagtttgacgtgggtaacgttgtgatggtgactggaggcagaaacagagggcgtgtgggtgtgattaagaaccgtgaaaaggcaattctcgagc

SEQ ID NO: 1530 - DNA, 1085 bp, Artificial
  Synthetic
gccattacggccggggagggctgttaaggtggctttcacatgagcggagcagcaggtaagcttagttactgcagaaagtggcggagctgtgacgctgctgattcaaatctaaagaccaccaaaatggctagaggtttgaagaaacatttgaagaggctcaatgccccaaagcattggatgcttgacaagcttggaggagctttcgctcccaagccctcgtctggtccgcacaaatcaagggagtgtttgccattgatcattatcatgagaaacaggctgaagtatgccctgacatatggcgaggtcatttcaattttaatgcaacgacttgttatggttgatgggaaagttaggacagataagacttaccccgccggctttatggatgttgtttcaattcccaagacaaatgagaacttccgcctcatgtatgacacaaagggccgatttcgtcttcactcagttagggatgaggaagccaagtttaagctgtgcaaggtccgatctgtgcagtttggacagaagggtattccatacctcaacacttatgatggaagaacaatccgctaccccgatcctctcatcaaggccaatgataccatcaaactggacttagagaacaataagattgttgacttcatcaagtttgatgtcggaaatgttgtcatggtgactggtggtagaaacagggggcgtgttggtgttattaaaaacagggaaaagcataagggtagtttcgagacagttcacattcacgatgcccaagggcatgagtttgctacccgcttgggtaatgtgttcactctcggaaaaggtactaagccatgggtttccctccctaaaggaaaaggtatcaagttatccatcattgaagaggcacggaagagacttgctgctcaatcagcaaccactacttaaaatgtgtggtcgagctatagactgatcaaacttttttgctggttggacctaatgtttatttttattttagcaataccaattttatttttactaccctgcaaacatttgtgttctatgtttttgtgaacctatagctttttgttaggataaaaaccctgaagactttt

SEQ ID NO: 1531 - DNA, 581 bp, Artificial
  Synthetic
tgcccacgcgtctgcccacgcgtctgcccacgcgtctgggcagtagttcttttactgccatagccacgctgccgaagctggagctggatgcatggaggaagaagaaggagaaggaggaggaggaggagcagcagtccagctatggcgcgaggattgaagaagcacttgaagcggctcaatgccccccgccactggatgctctttaaacttggcggtgccttcgcccccaagccctcagcaggtccccataaagagagggagtgcctgccccttgttgttcttctcaggaacaggttgaaatatgcactcacataccgtgaggttgttgcaattgtcatgcaacgacttgtctccgttgacggaaaggtccgtactgacaaatgttaccctgctggatttatggatgtcgtttcaattgcccgaaccaacgagaatttcagactcttgtatgacagcaaggggaggttcactgtccactctgttggtgtggaagaagccaggtacaagctctgtaaggtgaaagcagtgaggtttggcgataaaggaatccccttcctcactaccaacgatgggcggacgat

SEQ ID NO: 1532 - DNA, 842 bp, Artificial
  Synthetic
ccaacttctcccgggcagctgttcaaatcggaaaaccgccgaaatggcaagagggttgaagaaacatttgaagaggctcaatgcgccgaagcattggatgcttgataagcttggtggggcctttgctcccaagccttcttctggtccacataagtcaagggagtgtttgccattgattattatcctcaggaacagactgaaatatgctttgacataccgtgaggtcatctcaattttgatgcaacgacaagttatggttgatgggaaagttaggactgataagacttaccctgctggtttcatggatgttgtttccattccaaagacaaatgagaacttccgattgctttatgacactaagggtcgcttccgtctccactcactcagggatgaggaagcgaagttcaaactttgtaaggttcgatcggtgcagtttggacagaaggggattccatatctcaacacttatgatggaagaacagttcgctacccagatcccctcatcaaggccaatgacaccattaagttggatttagaatccaataaaattgttgacttcatcaaatttgatgttggaaatgtggtcatggtgactggtggtagaaatagggggcgtgttggagttattaagaacagggagaagcataagggtagctttgagaccgttcacattcaggatgccctggggcacgagtttgctacccgcttgggaaatgtgttcactcttggtaaaggtactaagccatgggtatctcttcctaaaggaaaaggtatcaagttatctatcattgaagaggctcgcaagaggctggctgctcaatcagctacagctgcttaaaaac

SEQ ID NO: 1533 - DNA, 658 bp, Artificial
  Synthetic
tgcctttgctcattcctttccctcctctaccccctatggctgcccttgaggcctcctgtgttgctcagagtctgtctgtagtgagctgccaagcatctggcaatgtccgtccatcctcggctttcttgggtttaggcctaaagaagggggggtcttcttctgggaatgcaaagaaggcttcattgcagaagattgcagcatcggtagacggggatgaaacaaagcagacgaaaacggacaaatgggccggtctggccttcgacacctcggacgaccagcaggacatcacccgagggaagggtatggtggacccactcttccaaggtgctgtgggtttgggcacccaagaagctgtcatgagcacctatgactacattagcaccggtcagaggacgttacaatgggacaatatgaaagatggtttctacattgcccctgcattcatggacaagcttgtcgtccacattactaagaatttcatgaatcttcccaacatcaaggtgccattgatccttggtatctggggaggcaaaggtcaagggaaatcattccaagctgagcttgtcttcgccaagatggggattaacccaatcatgatgagtgcgggtgagttggaaagcgggaatgctggtgagccagctaaactaatccgacaaag

SEQ ID NO: 1534 - DNA, 1194 bp, Artificial
  Synthetic
gccattacggccggggaaccaatttttgaatatattgagcaaatcaagaaagctcaatccttagcttctttgatcaagttgtcatcacagtagtcaagataatggctacctctgtgtcaaccattggagctgccaacaaagcaccgttgagtttgaacaactcagttgctggaactttagttccaagcacagccttctttggcaaaactttgaagaaagtgtatggaaaaggtgtttcaagccccaaggttacaaacaggagcttgaggattgcagctgaagagaataaagatgctgatcccaagaaacagaccgatagtgacagatggaagggtcttgtccaagacttttctgatgatcaacaggacatcacccggggtaagggtatggttgacagtcttttccaggctccaacaggtactggcactcaccatgctgttttgcaatcctacgaatatgtcagccaaggtcttcgccaatacaacatggacaacacattggacggattctacatcgctcctgctttcatggacaagcttgttgttcacatcaccaagaacttcttgaaattgcccaacatcaaggttccacttatcttgggtatctggggaggcaaaggtcaaggtaaatctttccagtgtgagcttgtcttcagaaagatgggaatcaaccccattatgatgagtgctggagaattggaaagtggaaatgcaggagagcctgcaaaattgattaggcaaaggtacagagaggcagcagaaatcatcaggaaaggaaacatgtgttgcctcttcatcaacgatctcgatgcaggagctggtagaatgggtggaactacccaatacactgtcaacaaccagatggtgaatgccactctcatgaacattgctgataacccgacaaacgtccagctccccggtatgtacaacaagcaagagaacgccagggtccccattgttgtcactggtaacgacttctccacactgtatgctcctcttatccgagatggtcgtatggagaagttctattgggcaccaactagggaagacagaattggtgtttgcaagggtattttcaggaccgacaacgtgcctgaggaagccgttataaagattgttgataccttccctggacaatctattgacttcttcggtgctctgagggcacgagtatacgatgatgaggtgaggaaat

SEQ ID NO: 1535 - DNA, 663 bp, Artificial
  Synthetic
attggatagtcagctcagctcaagaggaagacatggccatggctaccacactcctcgaggcttcgtgtgctactttgggatctcctctaggtggtcaaccagttgcgagttctaagtctggtggccctgtgtctctgtttttgggggcgggtctgaggaagtgctgcagcgtgcacatgcgcagaagcaggagcagagcagtgaaggttgtggcgttggaggatgagacgaagcagacaaagacagaccgatgggcggggcttgcgacggacatatcggatgaccagcaggacattgcacgagggaagggcatggtggacgcactcttccagggccccagtggtgaaggcacccagcatgccgtcatgagttcctatgagtacattagctctgctcaacgcacgcttaactgggacaacattaaagatggatactacatctcaccatccttcatggacaagctggttgttcatgtcactaaaaacttccttacacttccgaacattaaggttcctttgattctgggtgtatggggagggaaagggcaagggaagtctttccagtgcgagctggtcttcgctaagctcggaattacgcccataatgatgagtgctggagaattggagagtggaaatgcaggtgaacccgccaagcttatccggc

SEQ ID NO: 1536 - DNA, 687 bp, Artificial
  Synthetic
gacttctctaagccttctcttggatcttgcctttgctcattcctttccctcctctaccccctatggctgcccttgaggcctcctgtgttgctcagagtctgtctgtagtgagctgccaagcatctggcaatgtccgtccatcctcggctttcttgggtttaggcctaaagaagggggggtcttcttctgggaatgcaaagaaggcttcattgcagaagattgcagcatcggtagacggggatgaaacaaagcagacgaaaacggacaaatgggccggtctggccttcgacacctcggacgaccagcaggacatcacccgagggaagggtatggtggacccactcttccaaggtgctgtgggtttgggcacccaagaagctgtcatgagcacctatgactacattagcaccggtcagaggacgttacaatgggacaatatgaaagatggtttctacattgcccctgcattcatggacaagcttgtcgtccacattactaagaatttcatgaatcttcccaacatcaaggtgccattgatccttggtatctggggaggcaaaggtcaagggaaatcattccaagctgagcttgtcttcgccaagatggggattaacccaatcatgatgagtgcgggtgagtaggaaagcgggaatgctggtgagccagctaaactaatccgacaaaggt

SEQ ID NO: 1537 - DNA, 766 bp, Artificial
  Synthetic
cccacgcgtccgtcgcacagagcaacaagaagagcaacggatcattcaaggtgttggctgtgaaagaagacaaacaaaccgatggagacagatggagaggtcttgcctacgacacttctgatgatcaacaagacatcaccagaggcaagggtatggttgactctgtcttccaagctcctatgggaaccggaactcaccacgctgtccttagctcatacgaatacgttagccaaggccttaggcagtacaacttggacaacatgatggatgggttttacattgctcctgctttcatggacaagcttgttgttcacatcaccaagaacttcttgactctgcctaacatcaaggttccacttattttgggtatatggggaggcaaaggtcaaggtaaatccttccagtgtgagcttgtcatggccaagatgggtatcaacccaatcatgatgagtgctggagagcttgagagtggaaacgcaggagaacccgcaaagcttatccgtcagaggtaccgtgaggcagctgacttgatcaagaagggaaagatgtgttgtctcttcatcaacgatcttgacgctggtgcgggtcgtatgggtggtactactcagtacactgtcaacaatcagatggttaacgcaacactcatgaacattgctgataacccaaccaacgtccagctcccaggaatgtacaacaaggaagagaacgcacgtgtccccatcatttgcactggtaacgatttctccaccctatacgctcctctcat

SEQ ID NO: 1538 - DNA, 644 bp, Artificial
  Synthetic
tgttcgatcagtctatggcggcatcgtcaatgcagctcctaacccaggcctccgcccatccgatcggcgcgagatcgtcgctggcatcggcattcttggggagcggcatccatcagcacgaatccagtgcgcgagctggaaacctccgggctagatgccgggtagtgtgtgaattggaggaatcctcgaaggaggtcgatcgatggcagtctctggggaccgatacgtcggacgatcaacaagatatcaccaggggaaagggaatggtggataatctgtatcaagggcctcaagggggaggaacacagactgccgttatgtcgagtctagagtatatcaacactgcccagcgcatgtactctatggacaacaccaaagatggattttacatcgccccagcgttcatggagaagctagttattcacatatcaaaaaatttcatgacacttccaaatgtaaaggttcctcttatacttggtgtctggggtggcaaaggtcaaggaaagtcgttccagtgcgaactggtgttctccaagctgggaattaatcctatcacgatgagtgctggagagcttgagagcgggaatgctggagagcctgcaaagcttatccgggagcggtatcgcgaagcagcagatattatc

SEQ ID NO: 1539 - DNA, 876 bp, Artificial
  Synthetic
aggcaagacctagctagctcttcgtcctcgcggtacatcgcaatggcgtcgtctctccaggcggtccccgttgctcaggcgatgagcttgccagcagcacagaagtcctcgtccaaggtttcatgcctcaactcccagttcctgggcctcaacgtcaagagaaagaccgtgttccaagcttctctgtccggtgccgctggacgcggccgggtggtctgcgagaaagttaaggacacagaggacgagaccaagcagacggccaaggatcgctggggaggcctgggcaccgatatctcggacgaccagcaagacatcacccgtggtaagggaatggttgacaccctttaccaaggagctatcggaatgggaacccagcatgccatcatgagcagctatgagtacattagcactgcccagcgccactttgcgtttgataacaccaaggatggcttctacatcgcacccgcattcatggaaaaacttatgatccatatcgccaagaacttcatgacacttccaaacatcaaggtgccgctgattcttggtatctggggaggcaaaggtcaaggaaaatcattccagtgcgagcttgtcttctccaagctcggtgtcaacccgatcatgatgagcgctggagaactcgagagcggaaacgccggagagcccgccaagctcatcaggcagaggtaccgtgaagctgccgatatcatcaagaagaaaggcaagatgtgctgcctcttcatcaacgatctcgacgccggcgccggacgaatgggtggaacgacgcaatacacggttaacaaccagatggtgaacgcgacgctgatgaacatcgccgacaatcccacgaatgtacagctccccggaatctacaac

SEQ ID NO: 1540 - DNA, 437 bp, Artificial
  Synthetic
gaccatggctacctctgtctcaaccattggagctgttaacaaagcaccgttgagtttgaacaactcagttactggaacttcagttccaagcacagctttctttggcaaaactttgaagacagtgtatgggaaaggtgtttcaagccccaaggttacaaacaagagcttgaggattgcagctgaaaaaatagatgctgatcccaagaaacagaccgacggtgacagatggaagggtcttgtccaagacttttccgatgatcaacaggacatcacccggggtaagggcatggttgacagtcttttccaggctccaaccggtactggcactcaccatgctgtgttgcaatcctacgaatatgtcagccaaggtcttcgccaatacaacttggacaacaagttggacggattctacatcgctcctgctttcatggacaagc

SEQ ID NO: 1541 - DNA, 362 bp, Artificial
  Synthetic
cccttaggggaaggggtttctccaattcctttttcaagcttccaccggtgaatgcaccgaacaagccctccttaacttctaacaataccttaacccagggcttaaaacctaccaatttcaccacccccttggaaggtttttccttcccccttgttttattgaccaacttggtggccccattttcaaaaactttattaaccttcccaacattaagggcccaattattcttggtattttgggaagccagggtcaaggaaaaatctttccaggggaacttctttttccccaaaaggggaataaccccattattaataacccccgaaaacttgaaaaccgcaacccccgaaaacccgccaaactta

SEQ ID NO: 1542 - DNA, 1027 bp, Artificial
  Synthetic
cccggagcagcagcggccggccatcatcagtgatcctctacaatcatcgactttcagcaaattaagatggctgctgccttctcctccaccgttggagctccggcgtccactccgaccaacttcctggggaagaagctgaagaagcaggtgacatcggcggtgaactaccatggcaagagctccaacatcaacaggttcaaggtgatggccaaggagctggacgagggcaagcagaccgaccaggacaggtggaagggtctcgcctacgacatctccgatgaccagcaggacatcaccagggggaagggtttcgtcgactcccttttccaggctcccacgggtgatggcacccacgaggccgtcctcagctcctacgagtacctcagccagggtctcagaacgtacgacttcgacaacaccatgggaggcttctacatcgcccctgctttcatggacaagctcgtcgtccacatctccaagaacttcatgaccctccccaacatcaaggtcccactcatcctgggtatctggggaggcaagggtcagggaaaatccttccagtgtgagctcgtcttcgccaagatggggatcaaccccatcatgatgagcgccggagagctggagagcggcaacgccggagagccggcgaagctgatcaggcagcggtaccgtgaggcggcagacatcatcaagaaggggaagatgtgctgcctcttcatcaacgatctggacgcgggtgcaggtcgcatgggaggcaccacccagtacacggtgaacaaccagatggtgaacgccaccctgatgaacatcgccgacaacccaaccaacgtgcagctccccgggatgtacaacaaggaggacaacccccgtgtccccatcatcgtcaccggcaacgacttctccacgctgtacgcgccgctcatccgtgacgggcgtatggagaagttctactgggctcccacccgcgacgaccgtgtcggcgtctgcaagggtatcttccgcaccgacaacgtccccgacgaggaca

SEQ ID NO: 1543 - DNA, 1070 bp, Artificial
  Synthetic
gaattcaactctcctgctatcttttacagaaagtagtactcagattgcagaagtctgatcagacatggctgctgctttctcaaccgttggagcagttaacagagcacctttgagcttgccaagctctggccaaagctctgccttcttgggcagcagcttgaagaaggtcaattcttctgttgcaccaaaaccatcatcaagaagcttcaaagttgttgctgcacaagaggttgatcctaaaaagaatgaggacaaatgggccggtctttactacgaccagtctgatgatcaacaagacatcaccagaggaaagggaatggttgactcccttttccaagctcctatggataccggaactcacaatgctatcatgagttcttatgaatacgccagcaagggacaaagaacatacgactttgacaacaccatgagtggattctacattgctccagctttcatggacaagcttgttgttcacattaccaagaacttcatgacccttcccaacatcaaggttcctctaattttgggagtctggggaggaaagggacaaggaaaatcattccagtgtgagcttgtcatggccaagatgggaatcaacccaatcatgatgagtgccggagagcttgagagtggaaacgcaggagagcccgcaaagttgatcaggcaacgttaccgtgaagcagctgacattatcaagaagggaaaaatgtgttgtttattcatcaacgatcttgatgcaggagctggacgtatgggtggaaccactcaatacacagttaacaaccagatggttaacgccaccctcatgaacattgctgataacccaacaaatgtccagctccccggtatgtacaacaaggaggagaatcctcgtgtaccaatcatctgtaccggtaacgatttctccactttgtatgctcctcttatccgtgatggacgtatggagaagttctactgggcacctactcgtgatgaccgtattggtgtctgcaagggtatcttcaagactgataacatttctgatgaagctatcatcaagattgttgataccttcccagggcaatcta

SEQ ID NO: 1544 - DNA, 674 bp, Artificial
  Synthetic
gtcagctcagctcaagaggaagacatggccatggctaccacactcctcgaggcttcgtgtgctactttgggatctcctctaggtggtcaaccatttgcgagttctaagtctggtggccctgtgtctctgtttttgggggcgggtctgaggaagtgctgcagcgtgcacatgcgcagaagcaggagcagagcagtgaaggttgtggcattggaggatgagacgaagcaaacaaagacagaccgatgggcggggcttgcgacggacatatcggatgaccagcaggacattgcacgagggaagggcatggtggacgcactcttccagggccccagtggtgaaggcacccagcatgccgtcatgagttcctatgagtacattagctctgctcaacgcacgcttaactgggacaacattaaagatggatactacatctcaccatccttcatggacaagctggttgttcatgtcactaaaaacttccttacacttccgaacattaaggttcctttgattctgggtgtatggggagggaaagggcaagggaagtctttccagtgcgagctggtcttcgctaagctcggaattacgcccataatgatgagtgctggagaattggagagtggaaatgcaggtgaacccgccaagcttatccggcaaaggtaccgggaagcagc

SEQ ID NO: 1545 - DNA, 408 bp, Artificial
  Synthetic
ggaagagagagagagagagagacagatagagatagatagatagagagagagagagagagagagggcgcctctcttagcttttttttttttcatctaccggccttctcacccttttcttcttcttcttcttctctctctctctcctctctctggctggctggactggatctatctatcatcgatccatcatgggtacccggaagcgcaccctcctcaaagtcatcatcctcggagacaggggggttgggaaaacatctctggtggatccatatgttaacaaaaagtacaggaatcagtacaaggggaatattggagctggtttccttaccaagggggttcaagttggtgacaggcttggcaccatggagatctgggatactgggggccaagagcgctttcaaagtcttg

SEQ ID NO: 1546 - DNA, 493 bp, Artificial
  Synthetic
gagcaaaagccagcctcgtcattgaagcctcaaagtataggcagccggcattcaaggtctcgtgacgcttgcgacgctgatttcttccatcacactaccggacactcttttttcgatatccatcatcacctttccgccaccagaagcacccggagaaggcctcttcgctcgcggcggctgtgcttttggctcatatctatcacgtcattggagccccgagtgtacgacgataaccagtcaagatgtcttcgcgcaacaagaaggtccttctcaaggtcatcatccttggagatagcggtgtgggcaagacgagtttgatgaaccaatacgtcaacaagaagttcagcacaagctacaaagcgactatcggcgctgatttcttaacgcgagaggtcctggtggacgaccgacaagtcaccatgcagctctgggacacagccggacaagagagattccagtctctgggcgtcgcattctacagaggagccgactg

SEQ ID NO: 1547 - DNA, 452 bp, Artificial
  Synthetic
gtttgcgtgtagagctctcgccgaaggcctgaggggtgctgggatctacaccatcagctcaagcatggcatccaggaagcgaactctcctcaaggcgatcattctcggcgacagcggatacgtgaacaagaaatttagcaaccagtacaaggcgaccattggagcggattttctcaccaaggaagtccaagtggaggataggctactgacgatgcagatatgggatacagccggtcaggagcgattccaaagccttggtgtggccttctatcgaggggctgattgctgtgtgttggtatacgacgtgaatgtgatgaagtcgtttgataatctggacaactggcgcgacgagttcctcatccaggcaagtccttctgatccagagaacttccctttcattgttcttggcaacaaggttgatgtacacggggggaacagcagagtggtatccg

SEQ ID NO: 1548 - DNA, 607 bp, Artificial
  Synthetic
ctcccttctaacagttgattataggaggacttcaatttctgaaagatcgtttcaaatttactggtttttattcattttttagctccgtttaacccttttgaacaaaaataatggcagctcgaaggcggatgcttctcaaggtcataatcctaggcgatagcggggtgggaaagacatctctgatgaaccagtatgtgaatcgtaagtttagtaaccaatacaaggcgacaatcggagctgatttcttgacaaaagaaattcagtttgaggataggttatacacattgcagatatgggatacagctgggcaggaaaggttccaaagcctgggtgtagctttttaccgtggagcagattgttgtgttctagtatatgatgtgaatgttatgaagtcatttgagaatcttaacaactggagggaagaatttttaatccaggcaagcccatctgatcccgagaacttcccatttgtcgtagtggggaataagatagatgttgatggtggcaacagtcgagtggtctctgagaagaaagtaaaggcatggtgtgcttccaagggaaacataccatattttgagacctcagcaaaagagggattcaatgtgga

SEQ ID NO: 1549 - DNA, 621 bp, Artificial
  Synthetic
tctctctgtatttgttcttcttaaaaatcccttttacagaaaacccaaaagtagtgcaaaaattgagaattaatggcaaatctaggaggaattcgtgaggcaggaggatctgagaacagccttgagatcaatgatcttgctcgctttgctgttgatgaacacaacaagaaacagaatgcacttctggagttcggaaaggttgttaatgtgaaggaacaagtggttgctggaaccatgtactacataacactggaggcaactgaaggtggtaagaagaaagcatacgaagccaaggtctgggtgaagccgtggcagaacttcaagcaattggaagacttcaagcttattggggatgccgctagtgcttaacaagtgctaaatgaatgcatcttatgcttgtgaaaataaaggtaacatagtttcgcttgcgagtatttgaatatcgtaaagtaagctttaaactatgtcgtagtgttaagttacaagtaactgtaactttacaatgttccatatttcatattatatggtcctccatatgatagttctatgatatatcttgtatatgtactgcttttctattgctaatatatatctgagaagcataagcaattgcctttttga

SEQ ID NO: 1550 - DNA, 346 bp, Artificial
  Synthetic
agagaagacgatgatgctaggaggcgttcatgatctccgaggaaatcagaacagtggagagatcgagagtctcgctcgatttgccattcaagaacataacaaacaacagaacaaaattcttgagttcaagaagattgtcaaagcaagggagcaggtagttgcaggaacgatgtaccacttaaccctagaagcaaaagaaggtgatcagactaagaattttgaagccaaagtgtgggtgaagccatggatgaacttcaaacagttgcaggagttcaaggaatcatcttcttgaatttcacttgttcaagttaatgattacaaatgctctgagagtaattaattatat

SEQ ID NO: 1551 - DNA, 683 bp, Artificial
  Synthetic
cacgcgtccgcccacgcgtccgcccacgcgtccggccgccctgctcgtgctgcattcgctagccacgccgtccgctcaggccgaggcgcatcgcgcagggggagaaggggaggagaagatgtcgagcgacggagggccggtgcttggcggcgtcgagccggtggggaacgagaacgacctccacctcgtcgacctcgcccgcttcgccgtcaccgagcacaacaagaaggccaattctctgctggagttcgagaagcttgtgagtgtgaagcagcaagttgtcgctggcactttgtactatttcacaattgaggtgaaggaaggggatgccaagaagctctatgaagctaaggtctgggagaaaccatggatggacttcaaggagctccaggagttcaagcctgtcgatgccagtgcaaatgcctaaggcccatctcgtatcctatgtgtatcaagttatcaagaagatggggaataatatggtgtggatatagctattggacatgttaattatccacatgataatatggcttggatataaggatctcacacgataatatggcttggatatatagctattaaagattttacctatggcatatttcaatgtgtattagtactaagtaagaatgattgcaaggtgtattaactacaaatattgcaataaaagtccctgttactac

SEQ ID NO: 1552 - DNA, 1190 bp, Artificial
  Synthetic
gtgttcgacttcaagtaccccgcattttgtggtaatttctgctgtgcatagatggaaaatatcaatttgttccagatgcggcaaaatttatcacaaaattaggtagaactgatgtgagagatgtagaagttttgagtgagatttatatctctatcaatgacaattacaaatcttacaaagactttaaggtgcttgatgctttggataaggctttagtggatagatatcgatccccttatagtgctatttctgctttggtttctttatgttatcatatctttgactttaataagtttaagttgctgtttaattgtgaagggaaatttgtggataagaagctgagaaaagacttcgagtggtgaactctaggtcctgatgtttaaatctactgtatttaccttcgcattaattaagcatggccgaggaggcgcagagccacgcggcgtgaaggtgggcggcatccacgacgcgccggccgggcgcgagaacgacctcaccaccgtcgagctcgcccggttcgccgtcgccgagcacaacagcaaggccaacgcgatgttggagttggggagggtggtgaaggtgaggcagcaggtggtgggcgggttcatgcactacctcaccgtcgaggtgaaggaacccggcggcgccaataagctgtacgaggccaaggtgtgggagagggcgtgggagaacttcaagcagctccaggatttcaagcccctcgacgacgccaccgccgcggccgcttatccgtatgatgttccggattatgccgagctctacaaacagctgttgaattttgatttgctgaagttggcgggtgacgtggaatctaaccctggtcctaggtctagaatggctactttctcttgtgtgtgttgtggtaccttaactacaagtacttactgtggtaagagatgtgagcgaaagcatgtatattctgaaacaagaaataagagattggaactttacaagaagtatctattggaaccgcaaaaatgcgccctgaatggaatcgttggacacagttgtggaatgccatgctccattgcggaagaggcttgtgatcaactgccaatcgtgagtaggttctgtggccaaaagcatgcggatctgtatgattcacttctgaaacgttctgaacaggagttacttcttgaatttctccagaagaagatgcaggagctgaa

SEQ ID NO: 1553 - DNA, 758 bp, Artificial
  Synthetic
cccacgcgtccggttgaaggagaaaagagaaacgagtgcagtctgagtctgtccacagatgagagtatctcgaaacgccacactgctatttgttttaattttgtcattaagttttctcttctctgcgtttgggttaagcgaaaccggaggaggattttgcggtgaagaggaagagaaaggaaataatctgattgagatggctactcttggtggggttcgtgattcgcatgcttcgtcccacaacagcgacgagatccataaccttgccaaatttgctgtcgatgagcacaacaagaaggagaatgcgatgattgaatttgccagagttgtgaaggcgcaagagcaagttgttgctggtacactgcaccatctgactcttgaggtcatagatgctggaaaaaagaaactctatgaggctaaggtctgggtcaaaccatggttgaatttcaaggaacttcaagagttcactcatgttgaagatgttcctaccttaacttcttcagatctaggtgttaagcaagaagaggaaggctctggattgaagtcagtgcctgtgcatgatccggtggttcaggaagctgcagagcatgcaattaagaccatccagcagagatccaactcgctacttctgtatgaactccaagagattgttcatgcaaatgctgaggtcattggggaggacaatatgaagcttcatatgctcatcaaaactagccggggagggaagcgagaaaagttcaaagttcaagtgcaccata

SEQ ID NO: 1554 - DNA, 655 bp, Artificial
  Synthetic
cccctagaggttgcacactgcgcatcatcaccctcctcgtctctccatctcaggtgagacgttactatctttctatgttcttatgtcattagtggtgattgcaagacttaggtctgcatctcagtcattgagaggcattggacaaaatcatacaatcaaagcttgcttcttccagagaaaatttgcatatatttctgaagcgaaggccatggatgccccggaggagattagtaagataaagatgtttggtggatacattaaacgctacaaacatcagagctctacacttggctgtgctatgaatttcacgatatatttccctcctgctgcacaagagaagaaagttcctgttttatactggctgtcggggcttacatgcacggatgaaaactttgtgcaaaaaagtggagctcaaagagcagctgcagcttgtggcatagctttggtagctccagatacatcaccaagaggtcttaacgtggaaggagaatcagaaagttgggattttggtgttggggctggtttctatcttaacgctgcacaggagaaatggaagaactggcgaatgtatgactatgtgacggtagagataccgaggctccttagtgctaactttggtgagcttgatacagcatgcgcttctctctctggacac

SEQ ID NO: 1555 - DNA, 607 bp, Artificial
  Synthetic
gatccgagaacagcagattcagagatggaggaaaaaccctgtgagatcagcagcgtaaagatgtttggaggttacaataagagatataagcacttcagtccgactctgggttgctccatgaccttccacatttacttccctccatccccttctccatcccacaaatttcctgtactttattggctgtctggcctaacttgctccgatgagaactttattgtcaaatctggagctcagcgtgcagcttccagcgaaggtgttgcgctaattgccccagatacatccccaagaggccttggagtggaaggagaggcagacagctgggattttggtgtaggtgctgggttttatcttaatgctactcaagagaaatggaaaaactggcattcaatgggtgggcatggtgctttgacaatctacttgaaaaacctcgacaagtacaagtctgtatccgcctttgcacctattgttaatcccataaattgcccatggggtcagaaggctttctcaaactatttgggcgacgaaaaatctgattgggaggaatatgatgccacttgcctaatttctaagtacaacaatgttttggccaccatcctaattgatc

SEQ ID NO: 1556 - DNA, 772 bp, Artificial
  Synthetic
  misc_feature (695)..(695): The residue at this position can be any nucleotide.
agggtctatctattcatctttctctctctctctctctctctctctctctctctaggtcttcttcttgttgataatccatggctatggctatgtctgtggctatggcttccccctcctctttggcattgccctcttcttcctcctcctcctccctcctcgtcaagtcctccttctccggagcccgccttgccctcgtgccggcttgctttgtctcccctcgcctcccctcttgcgccctcaccgtcgtagccgccgagaagaaggctgttgctgtcctcaaagggacctccaatgtcgaaggcgtcatcaacttgttccaggaagacggcggccccacaaccgtgaaggtcaaaatttctggtttagcacctggcaagcacggattccacctccaccagtttggagacaccaccaatggctgcatgtcaacaggtcctcattttaaccctcagggacttacacatggtgcccctgaagatgaagttcgacatgccggtgatctagggaatgttgttgcgggacctgatggtgttgcagaagccaccatagttgactcacaaattcctttgtctggacctaattccgtaattgggagagcctttgtcattcatgaacttgaggacgatctgggaaaaggaggacacgaacttagccctacaactggtaatgctggaggtcgacttgcttgtggtatngtgggtctctctccataaattttctacaaggagatatcaagtttagttgggtgggttggcttcatcagtaaagcaga

SEQ ID NO: 1557 - DNA, 924 bp, Artificial
  Synthetic
ccccccgattttccattatttcctaactcctgagtatcacagacatatttgacttctatcttcctctctttctctctctagccattcaaggggttccctgagactcttgtatcataattttctagatcacacatacaaaaatggtgaaagccgttgccgtccttagcagcagtgaaggtgttagtggcaccatcttcttcactcaggatggagatgcaccaaccacagttactggaaatgtctctggcctaaaacccggatttcatggcttccacgtccatgcccttggtgataccacaaatggctgcatgtcaacaggaccacattacaatcctgctggtaaggagcatggtgctcctgaagatgaggtgcgtcatgctggtgatcttggtaacatcacagttggggaagatggtactgcatcttttaccattactgacaagcagattcctcttgctggtccacaatccatcattggaagagctgtagttgttcatgctgatcctgatgaccttggaaagggaggacacgagctcagtaaaaccactggaaatgctggtggaagggttgcttgtggtatcatcggcctccagggttaattactcatgtaccatgaagattctcagctactactagtggagggatctttgaataaggtttcattggagctattgagcattgttttctatgtttcatgtgatgctttttgtttttgaggtgaaccaatcatacatgatgtagatctaatttccagtgtgtgagttgtactagtttctgccaacaaaacattaaccgtaataaaacagtccttagcattgctggtttcttagatttgaatgttgtcaattcaattggatggtttcgaggcaatacaattcatatggatggaaaagacagcctgcgatttttttatcatatattgcg

SEQ ID NO: 1558 - DNA, 686 bp, Artificial
  Synthetic
tttctgtgtggcttcaaaatccccatcccttctcttatcccatcactctctctctctttctctctctctctctctctctcatagctagcatgggggtgaaggcggtggtagtcctatcaggcagtgctggtgtgggaggtgttgtccatttctcccaagaggacccccatggtcctacaactgttgagggtactcttagcggcctttcccctggattgcatggatttcatgtgcacgcccttggtgacaccacaaatggctgcatgtccacaggtccgcactacaatccggccagtaaagaacacggggctccggaggacgataatcgccatgcgggagacttagggaatatcattgttggacctgatggttacgcaaagatctcaattgtagataaagagattcctttgcttggagctagttcaatcattggtcgtgccgttgttgtccatgctgatcctgacgatctaggcaagggtggtcatgagctgagcaaatcaactggaaacgccggagggagacttgcgtgtggtgtcattggtcttcaggctgctgcttgaagaagcctaggctttacccccctacttgctggtattttcatactatatcttgctctttattaaagaattgtatctttctatctttgcccaagacaacaaaacagagaacatgttaccagctagaga

SEQ ID NO: 1559 - DNA, 578 bp, Artificial
  Synthetic
gagatggggttgaaggcagtggcagtgctttccggtagcgcaggagtcgctggtgtcgtccatttctctcaggacactcccaatggccctacaactgtggttggttctcttagcgggctttcccctggattgcatggatttcatgtccatgcccttggtgacaccacaaatggatgcatgtccacaggtgctcactacaatcctgccaacaaagtgcatggggctccagaggatgaagatcgccatgctggagatttaggaaatgtcactgtcggagatgatgggaaggcacagctctcaattacagactgccagattcctttggatggacctaattcaatcattggccgtgctgttgttgtacatgctgatcctgatgatctaggcaagggtggtcatgagttgagcaaaactactggaaatgctggaggaagacttgcgtgtggtgttattggtcttcaggctgcagcttgaaggtgtaccccctatatgcctctataagctttttaggtcttgtaatgaagaaataatatattttccgagggcagtgaaatagagaacctgtcatacaatcaagc

SEQ ID NO: 1560 - DNA, 666 bp, Artificial
  Synthetic
gtcaacaattatattctctcttggattgttgagacatatatcctcattcttaggcatgctgtttctatctgtactgtcctaatgataagctgatactgatgccaatttctgaagataatatacaaaggtaaggaatgtctgaaagttaagtatagctacaacaacgactactttgataggagcaacatgatgaagtgagtaacacaagtactaaacagatgactgaagcccaataacgccacaaccaactcttgcaccggcattcccagttgacttactaagttcatgtccacctcttcccagatcatcaggatcagcatgcacaactactgctctccccaagatggagtctactccaccaagtggaatcagcatatctgaaattgatatctcggccaccccatcaagaccagcaacaatgttgcctaaatcaccggcatgacgcacatcatcagtgggagctccatgatcgttcttaagtggattaaaatgaggtccagtggaattgcagccattggtagtatcgcccaaagcatgaatatggaaaccgtgaagacctggagcgagaccagtaattcttccgctcacatgggtagagccgttgggttgttggatgaactgtaaggagcctttgacgctattgttaccagagatgacagccactgc

SEQ ID NO: 1561 - DNA, 565 bp, Artificial
  Synthetic
tcagacaatcttagctggtgcaacaacagcaacatcagctaaaccacttctatcttcatcggggtcaaacccaattcctctttcattctcttctatcagtttccccacatcaaaacgttcatcttcaaggtctcttactgttgtttcagcattgaaaaaagctgttgctgtacttaaaggaacttctactgttgaaggagttgttactttaactcaagaagatgatggtccaactaccgtgaatgttaagatttctgggcttacacctggacttcatggattccatcttcatgagtttggtgatactactaatggatgtatctcaacaggtccacatttcaatccaaatggattgacacatggagctccttgtgatgaagtccgtcatgcgggtgacctgggaaacataacagctaatgctgatggcgtggcagaggcgacaatagtggatagtcagattccattaagtggaccaaatgcagtagttggaagagctttggtggttcacgagcttgaggatgaccttggaaagggtgggcatgagctcagccttagcacaggaaat

SEQ ID NO: 1562 - DNA, 410 bp, Artificial
  Synthetic
  misc_feature (396)..(396): The residue at this position can be any nucleotide.
  misc_feature (410)..(410): The residue at this position can be any nucleotide.
gcgaatggctgcttgtccacgggcgctcatttcaacccaaggaatctggagcatggagatccaactgacgatgtgcgacacgctggtgacctagggaatcttaaagctggcccggatggaactgtggacttcaccatcaaggataaacagattcctctcgctgggccggactcgatcgttgggcgcgccgtcgtcgttcatgctgatcgcgatgatcttggcagaggtggtcacgagctgagcaagtcgactggaaacgctggcggccgtcttgcttgtggtgtgattggactccaggcatctgcttgaatcctctccaactcgaagtataaagagttttgcagccagacactatgaggaataagtgatctctatattaatttctgttttaactgncttcaaagttctgn

SEQ ID NO: 1563 - DNA, 335 bp, Artificial
  Synthetic
aggctgtcgctgttcttcgaggagattccaaggtctccggtactgtcactttcgagcaggactctgagtccggccccgtcactgtcacctacgacatcaagggcaacgatcccaacgctgagcgaggattccacgtccacgagtttggtgacaacaccaacggctgcacttctgccggcccccacttcaaccccttcaagaagaaccacggtggtcccaccgactctgagcgacacgttggtgacctcggaaacgtcaagactgactctgagggtgttgccaagggtgttctcaaggactctcttctcaagctgactggtgacaactccattgtt

SEQ ID NO: 1564 - DNA, 628 bp, Artificial
  Synthetic
atcaactacttatactccccacactaccgccaaaatggtcaaggctgtcgctgttatccgtggtgactccaacgtcaagggcaccgtcaccttcgagcaggcctccgagtccgccgagacccagatctcctggaacgtcaccggcaacgatgccaacgccgagcgcggtatgcacatccacaccttcggtgacaacaccaacggctgcaccagcgctggtcctcacttcaacccccacaacaagactcacggcgccccctccgacagcgagcgccacgtcggcgacctgggcaacttcaagaccgacgcccagggcaacgccgagggctccgtctcggacaagttcatcaagctgatcggccccgagagcgtcctcggccgcactgttgtcgtccacgccggcactgacgaccttggaaagggcgagaacgaggagagcaagaagactggcaacgctggcgctcgtcccgcttgcggtgttatcggtatctcccagtagatgttgggacgatgccgaggagtagcaaggagaacttgatgatgatgatgaacaacgtgaaaagaaagtcacttgatgatgttgcgtaggacagcttgtagtttgtcgaatgataagctttcaagcacg

SEQ ID NO: 1565 - DNA, 532 bp, Artificial
  Synthetic
gatcaactacttatactccccacactaccgccaaaatggtcaaggctgtcgctgttatccgtggtgactccaacgtcaagggcaccgtcaccttcgagcaggcctccgagtccgccgagacccagatctcctggaacgtcaccggcaacgatgccaacgccgagcgcggtatgcacatccacaccttcggtgacaacaccaatgtgctgcaccagcgctggtcctcacttcaacccccacaacaagactcacggcgccccctccgacagcgagcgccacgtcggcgacctgggcaacttcaagaccgacgcccagggcaacgccgagggctccgtctcggacaagttcatcaagctgatcggccccgagagcgtcctcggccgcactgttgtcgtccacgccggcactgacgaccttggaaagggcgagaacgaggagagcaagaagactggcaacgctggcgctcgtcccgcttgcggtgttatcggtatctcccagtagatgttgggacgatgccgaggagtagcaagga

SEQ ID NO: 1566 - DNA, 633 bp, Artificial
  Synthetic
gaaggctttagttctattcatttggctttggtggagagactatggcgcccctcaaggcagtggctgttcttagcggcagcgccggcgtcgccggggtcgtgagcttcatccaggacgatgacgtgacgacggtgtcggggaagatcactggcttggcccccggcgagcacggcttccacgtccacgcattgggcgataccacgaatggctgcttgtccacgggcgctcatttcaacccaaagaatctggagcatggagatccaactgacgatgtgcgacacgctggtgacctagggaatcttaaagctggcccggatggaactgtggacttcaccatcaaggataaacagattcctctcgctgggccggactcgatcgttgggcgcgccgtcgtcgttcatgctgatcgcgatgatcttggcagaggtggtcacgagctgagcaagtcgactggaaacgctggcggccgtcttgcttgtggtgtgattggactccaggcatctgcttgaatcctctccaactcgatacttacatacagtataaagagttttgcagccagacactatgaggaataagtgatctctatattaatttctgttttaactggcttcaaagttctggaatttgtgtcaa

SEQ ID NO: 1567 - DNA, 643 bp, Artificial
  Synthetic
ggagtcttcctcatcagaaatcagaagaggggagggtgggcaactcgcagatcgccttctcgtcgcgctcgcgccgcaggggtcgcctgagaacacatagacaatggtgaaggctgttgctgtgcttgctagcagtgagggtgtcaagggcaccatccttttctcccaagagggagatggtccgacctctgtgacgggaagtgtctctgggctcaagccagggctccatggattccatgtgcacgcgctcggtgacaccactaatggctgcatgtcaactggaccacacttcaatcctactgggaaggaacatggggcaccacaagatgagaaccgccatgccggtgatcttggaaatataacagctggagcagatggtgttgctaatgtcaatgtctctgacagccagatcccccttactggagcacactccatcattggccgagctgttgttgtccatgctgatcctgatgatcttggcaagggtggacatgagcttagcaagaccactggaaatgctgggggccgagttgcttgcggaatcatcggactccagggttagacgtctcaactttccaacatacagaagctgttcatgttcgctcgtatggatgttgaaataaaaataagcacctgatgtatg

SEQ ID NO: 1568 - DNA, 751 bp, Artificial
  Synthetic
cccacgcgtccggagaaaattcagcatttttgatagctcaagcacttgattctttccaaaggggtttcctgagatcacaaaggccaagtaacaatggcgaaaggagttgcagttttgaacagcagtgagggtgttacggggactatctttttcacccaggaaggcgatggtgtgaccactgtgagtggaacagtttctggccttaagcctggtcttcatggtttccatgtccatgctcttggagacaccactaacgggtgcatgtctactggtccacatttcaaccccgatggtaaaacacacggtgcccctgaggatgctaatcgacatgctggtgatctaggaaacatcactgttggagatgatggaactgccaccttcacaatcactgattgccagattcctcttactggaccaaactctattgttggtagggctgttgttgtccatgcagaccctgatgacctcggaaagggaggccatgaactcagcctggctactggaaacgcaggcggccgtgttgcttgcggcatcattggtctccagggctaaagctgctacgtttccaaagaagagattgatgtaataaggaggtccaaccttagacctgggtttggtagttgtgtgtatcttctggtgtgtggctaaaaacctttgagcttagtgtggctcaaagcatctttaattcagacagaaaacagagaaaattccgtacttttattatttcatgaataaaaaagagttggtttac

SEQ ID NO: 1569 - DNA, 156 bp, Artificial
  Synthetic
cggaacatcatacggatagcggcggcttgaagtacgatgatccgcaagcacacggcaccagcgtttccggtggtcttgtcagctcgtgccaccctttccaagatcatcaggatcggatgcacaacgacggcttctgcaatgattgaatttggtcca

SEQ ID NO: 1570 - DNA, 923 bp, Artificial
  Synthetic
aaagttccaatctcttatttcttgtttcagaatatacatgctttcgctcacatctcttaccacagtaagtacttgtagttaaggtaccacaacacacacaagagaaagtagccattctagacctaggaccagggttagattccacgtcacccgccaacttcagcaaatcaaaattcaacagctgtttgtagagctcggcataatccggaacatcatacggataagcggccgcaccctggagtccgatgattccgcaagcaactcggcccccagcatttccagtggtcttgctaagctcatgtccacccttgccaagatcatcaggatcagcatggacaacaacagctcggccaatgatggagtgtgctccagtaagggggatctggctgtcagagacattgacattagcaacaccatctgctccagctgttatatttccaagatcaccggcatggcggttctcatcttgtggtgccccatgttccttcccagtaggattgaagtgtggtccagttgacatgcagccattagtggtgtcaccgagcgcgtgcacatggaatccatggagccctggcttgagcccagagacacttcccgtcacagaggtcggaccatctccctcttgggagaaaaagatggtgcccttgacaccctcactgctagcaagcacagcaacagccttcaccatgcttaattaatgcgaaggtaaatacagtagatttaaacatcaggacctagagttcaccactcgaagtcttttctcagcttcttatccacaaatttcccttcacaattaaacagcaacttaaacttattaaagtcaaagatatgataacataaagaaaccaaagcagaaatagcactataaggggatcgatatctatccactaaagccttatccaaagcatcaagcaccttaaagt

SEQ ID NO: 1571 - DNA, 555 bp, Artificial
  Synthetic
  misc_feature (383)..(383): The residue at this position can be any nucleotide.
cccacgcgtccgcggacgcgtgggtgggagcgaagcggcagagaatggcagggaaagccggcggcctcaagggcgtcgccctcatcggcggcgccggcggcaacagcgcggtcgccggcgccctccacttcttccaggacccctccaccgggtataccgaggtgagggggagggtcaccggcctcgctccgggcctccatggcttccacatccactcctttggcgacaccaccaacggctgcaactctaccgggccccattttaatcctcacaataagtcccatggggcaccatctgatgatgaaagacatgtgggcgacctgggaaacatagtagccaacaaagatggtgttgcagatatcttcataaaggacctacagatntcactaagcgggcctcattccatattgggaagggcagttgttgttcatgctgattctgatgacctaggaaggggtggtcatgaactcagtaaaacaacaggaaatgcaggagcaagaattggatgcggtatcattggacttcgatctgcagtttaacaatctatagtcatga

SEQ ID NO: 1572 - DNA, 494 bp, Artificial; identical to SEQ ID NO: 1252
  Synthetic

SEQ ID NO: 1573 - DNA, 1425 bp, Artificial
  Synthetic
ccccccgactcacacacacactcctcatcccagagcaagaagctcagctcctcctcctctcgcatggcagccatggccaccaccgcgtccagcctcctcaagacctccttcgccggcgtgcgcctccccgccgccgcccgcaaccccaccgtctccgtcgcgccgcgcaccggaggcgccatctgcaactccatctcgtcgtcgtcgtccactcccccctacgacctcaacgccatcaggttcagccccatcaaggagtccatcgtgtcccgcgagatgacccggcggtacatgaccgacatgatcacctacgccgacaccgacgtcgtcgtcgtcggcgccggctccgcggggctctcctgcgcgtacgagctctccaaggacccctccgtcagcgtcgccgtcatcgagcagtcggtgtcccccggcggcggcgcgtggctcggcgggcagctgttctccgccatggtggtgcgcaagccggcgcacctgttcctcgacgagctcggcgtcgcgtacgacgagcaggaggactacgtcgtcatcaagcacgccgcgctcttcacctccaccgtcatgagccgcctcctggcgcgccccaacgtgaagctgttcaacgccgtcgccgtcgaggacctcatcgtcaaggagggccgcgtcggcggcgtggtcaccaactgggcgctggtgtcgatgaaccacgacacgcagtcgtgcatggaccccaacgtgatggagtccagggtggtggtgagctcctgcggccacgacgggccgttcggcgccacgggcgtcaagcggctgcaggacatcggcatgatcgacgccgtgcccggcatgcgcgccctcgacatgaacaccgccgaggacgagatcgtccgcctcacccgcgaggtcgtccccggcatgatcgtcaccggcatggaggtcgccgagatcgacggcgccccgagaatgggcccgacgttcggagccatgatgatctccggccagaaggcggcgcacctggcgctgaaggcgctcggccggccgaacgccatcgacggcacgatcaagaaggcggcggcggcggcggcggcgcacccggagctgatcctggcgtcgaaggacgacggcgagatcgtggacgcctgagcgaatagaacagggtaaaaaaaaatccgcaagacgtggtggtgacacggaggcgttggggacgagaagaagatgtggactttcccctgtgttttttttttcgggatttgctttgatccccttgtttgttttagctctggatgttgattagcgtcttgttcatagcaattccactgccaccgtgtgtgtgtgctctgcttgcctgatgagggcaagaaaacttccatggatccgtctctctgggaggaatgaataaaaaggatgaggaaataaaaatgattcagtgccatt

SEQ ID NO: 1574 - DNA, 452 bp, Artificial
  Synthetic
ctagctgattaattaagtcgacccactgcgtcgtgatgatctccggccagaaggcggcgcacctggcgctgaaggcgctcggccggccgaacgccatcgacggcacgatcaagaaggcggcggcggcggcggcgcacccggagctgatcctggcgtcgaaggacgacggcgagatcgtggacgcctgagcgaatagaacagggtaaaaaaaaatccgcaagacgtggtggtgacacggaggcgttggggacgagaagaagatgtggactttcccctgtgtttcattgttcgggatttggtttgatccccttgtttgttttagctctggatgttgattagcgtcttgttcatagcacttccactgccaccgtgtgtgtgtgctctgcttgcctgatgagggcaagaaaacttccatggatccgtctctctgggaggaatgaataacaaggatg

SEQ ID NO: 1575 - DNA, 715 bp, Artificial
  Synthetic
cccccccgagtcacacacacactcctcatcccagagcaagaagctcagctcctcctcctctcgcatggcagccatggccaccaccgcgtccagcctcctcaagacctccttcgccggcgtgcgcctccccgccgccgcccgcaaccccaccgtctccgtcgcgccgcgcaccggcggcgccatctgcaactccatctcgtcgtcgtcgtccactcccccctacgacctcaacgccatcaggttcagccccatcaaggagtccatcgtgtcccgcgagatgacccggcggtacatgaccgacatgatcacctacgccgacaccgacgtcgtcgtcgtcggcgccggctccgcggggctctcctgcgcgtacgagctctccaaggacccctccgtcagcgtcgccgtcatcgagcagtcggtgtcccccggcggcggcgcgtggctcggcgggcagctgttctccgccatggtggtgcgcaagccggcgcacctgttcctcgacgagctcggcgtcgcgtacgacgagcaggaggactacgtcgtcatcaagcacgccgcgctcttcacctccaccgtcatgagccgcctcctggcgcgccccaacgtgaagctgttcaacgccgtcgccgtcgaggacctcatcgtcaaagagggccgcgtcggcggcgtggtcaccaactgggcgctggtgtcgatgaaccacgacacgcagtcg

SEQ ID NO: 1576 - DNA, 643 bp, Artificial
  Synthetic
gagagagagagaggagagagagagagagagactccaccatgaccgccattactgccctcactccgacctcccttgaacagaattgcacagccagacgcataccttccccttcttcctcttcctcccttgtcccccttccccgtcgcctccgcctctcccgcccgcacccgcacgcaagacggctcagccttcgcgcggaagcccccgggggtgaccccgccgctgtcctcgagcccgcctcgaaggaggaccccatccagcagttcctcaagcgcgactacaagtggggttttgtctccaacgtggagtccgagtccatccccaagggcctctcggaggagaccgtccgcctcatctctgccaagaaagccgagccggaatggctccttgagtttcgcctcaaggcataccgccggtggctcagcatggtggagcccaagtggtcggacaacgagcacccgaagatcgattttcaatcgtttcactactacacagagccgaagcggaaggaaacgaaggcaagcttggacgaggtcgatccggagctgctcgagacgttccggaaactgggcatacccataactgagcaaaagcggttggccaacgttgctgtggatgcagtatttgatagtgtatcgatcgc

SEQ ID NO: 1577 - DNA, 651 bp, Artificial
  Synthetic
acacacctcatctagtgatagtaatgggatcattctgtagaaggccaatgagtcggttggtgaagagagctattgatggccatgcacatcccactatgttcttcagctcccttacagcccatgctcatgcccatcctcatcatcacctccatatcaagaccgatgtctctcaggtggtgggaagaactcctattgtgttccttaacaaggtgactgaaggctgcggtgcctacattgctgcaaaattggaattgatgcagccttgcaatagtgtgaaagatagaattgggtacaaaatgattgctgatgcagaggcaaaggggcttatctctccagacaagacagtacttgtggagcccacatctggcaacatgggaatcgccctctctttcattgctgcagccaagggctacaacctgatcttgacaatgccctcatacacaagcattgagcgccgagtcacaatgcgcgcctttggcgcccaactcaccctcactgacccttccaaagggatgggtggaactgtcaaaatggcttatgaaattgcggacaaaactcccggtgctttcatgcttcagcagtttgagaatccctccaatgtccaggcacactttgagacaactggacctgagatatgggaagatactgtgg

SEQ ID NO: 1578 - DNA, 287 bp, Artificial
  Synthetic
cccacgcgtccgggttattgactttctcattcagtgaagcttgaatcatggcctcgagaattgctaaagatgtgactgaattgattgggaacactccattggtgtatttgaacaatgttgctgaaggatgtgttggtcgtgttgctgctaagcttgagatgatggaaccgtgctctagcgtcaaagacaggattggttttagcatgatttctgatgcagaaaagaagggtcttatcaaaccaggagagagtgtgctgattgagccaacaagtggaaacactggagtt

SEQ ID NO: 1579 - DNA, 913 bp, Artificial
  Synthetic
gaattcaacagcaatggcttcttcttctctttgttccaacccattaacttctatacccaaatctaaattagggttctcttcttctacttctaaaacccaatcttctttcgttaatttgagaaaatcatcaactcaatttgctagaaaacaactctcacagtcttctgttgttgtttgtaaggctgtttctgctgaaccatctactcaaattgaaggtcttaacattgctgaagatgtttctcagcttattggaaagacacctatggtttacctcaatactattgccaagggttctgttgcaaatattgctgccaagcttgagataatggaaccctgttgcagtgttaaagacaggatgggtttaagtatgattactgatgccgaggaaaaggggcctataacacctggaaagagtgtcttggtggaaccaaccagtggaaacacaggtatcggtcttgcctttattgctgctgcaagaggatacaaactcatcttaactatgcctgcatcaatgagtatggaaagacgagtccttctgaaggcatttggggcagagttagttcttacagaatccgccaagggtatgaaaggagctcttgcaaaagcagaagagatagtaaataagacacctaattcttacatgcttcaacagtttgacaacccagctaatccaaagattcactttgaaacaactggtcctgagatttggggagatacaagaggcaaagtagatatatttgtcgcaggaattggtactggtggaactatttctggggttggtcggtacctaaagaaacaaaatcccaacgtaaagattattggtgttgagccaacagaaagcaacgtactttcagggggaacacctggacctcacaaaattcaagggattggaacaggctttatacctggaaat

SEQ ID NO: 1580 - DNA, 676 bp, Artificial
  Synthetic
accgccggcagtgaccagcagcaaccaatcagcaaatcagcaatggagagggctctgatgagcctcatgaggcggcgctccctcctccagagcggcggacgagcaccgccggcgatggccgccgccgccggtggctcaccattcttctccaccctgcagcaagcagccgccgcagacccggtccagtcgcctggcatcttgccagggctcaagatcagggactctgcgtcacagctgattgggaggacacccatggtttacctgaacaaggtcactgaaggatgtggggcccggattgctgctaagctcgagttcttgcagccgtccttcagcgtcaaggacagaccagcaatttcaatgttggaagatgctgaaaagaaggggttgatcaccccaggcaagaccacactgatcgagccgacatcagggaacatgggtattggcctggcattcatggctgctcttaaagggtatgaactcatactcacaatgccttcatacaccagccttgagaggagggtgaccatgagggccttcggcgcaaaactcgtccttaccgacccaacaaaaggtatgggaggcacggtgaggaaggccgccgagctgtatgagaaccatcctagcgcgttcatgctgcagcagtttgagaatcctgcaaatgtcaaggtacactatg

SEQ ID NO: 1581 - DNA, 694 bp, Artificial
  Synthetic
gaattccagctgaccaccatgtcacaagaaacaaaaatgctaccttctctgtctagtcttctatcgggaaccgaaatctcgtccagccccgtatcaccaagcttcactaatccaagaacgagttttcacctcgatgatcgcggaaccataaaattaccaccgctaaacaccagtatcaatcgtccaagatctgtggaaagcgccttgagacacactgttacatccttgcatgaaaatagcagcgcttatggtgatgacatgctcaagcacacgcaatcagactcagccctctcatctcagttgaatagttctcaagaaacagttgatgaatcacacgaaaaccttctactgactcccctaaatagcaaaaagagagattattcggtttcttcaaagaaaaacgacatattaacaccactctctgcagcgaagtcgattattatcccctctgcctctaaggaaaaaagacgtgcatttgctttcatcacacactcgcaggagaccttccctaagaaggagcctaagatcgacaacgctccactagcacgccgaaagagaagaagaacctcgtcccaggaactatctattcttcaggctgaatttgaaaaatgtcctgctccatcgaaggagaaacgaattgagttagctgaatcttgccatatgactgaaaaagccgttcaaatatggttccaga

SEQ ID NO: 1582 - DNA, 629 bp, Artificial
  Synthetic
aacacctccgagtccgagcaacgcaagatggcgtcgtggtcgtcgcccgtcgccgccgccgccttggaggtccatttcgggtcctcctgcttcttctccgcccgatcgccacgacagaccctcctcctaccacctctcgcccgcaaccctacactgaccatccagccccggccccatcccttccggaacatcaactcctcctcctcctccagctggatgtgccacgccgtcgccgccgaggtcgagggcctcaacatcgccgacgacgtcacccagctcatcggcaagactccaatggtatatctcaacaacatcgtcaagggatgtgttgccaatgtcgctgctaagctcgagattatggagccctgttgcagtgtcaaggacaggataggatacagtatgatttctgatgcggaagagaaaggcttgataactcctggaaagagtgttttggtggaaccaacaagtggaaatacaggcattggtcttgccttcattgctgcttccagaggatataaattaatattgaccatgcctgcatcaatgagcatggagagaagagttctactcaaagcttttggcgctgaacttgtccttactgatgccgcaaaagggatgaagggggctgt

SEQ ID NO: 1583 - DNA, 607 bp, Artificial
  Synthetic
cccagtgagccacagcaccgccggcagtgaccaacagcaaccaatcagcaaatcagcaatggagagggctctgatgagcctcatgaggcggggctccctcctccagagcggcggacgagcaccgccggcgatggccgccgccgccggtggctcaccattcttctccaccctgcagcaagcagccgccgcagacccggtccagtcgcctggcatcttgccagggctcaagatcagggactctgcgtcacagctgattgggaggacacccatggtttacctgaacaaggtcactgaaggatgtggggcccggattgctgctaagctcgagttcttgcagccgtccttcagcgtcaaggacagaccagcaatttcaatgttggaagatgctgaaaagaaggggttgatcaccccaggtaagaccacactgatcgagccgacatcagggaacatgggtattggcctggcattcatggctgctcttaaagggtatgaactcatactcacaatgccttcatacaccagccttgagaggagggtgaccatgagggccttcggcgcaaaactcgtccttaccgacccaacaaaaggtatgggaggcacggtgagg

SEQ ID NO: 1584 - DNA, 295 bp, Artificial
  Synthetic
tgattgagccaacaagtggaaacactggagttgggttagcattcacggcagctgccgaaggctacaagcttattattacaatgccagcttctatgagtactgagagaaaaatcattctcttagcttttggagttgagttggttttaactgacccagctaagggcatgaaaggagctatcgcaaaggcggaagagattttggcgaaaacacccaatggttacatgcttcagcagtttgagaaccctgccaaccctaagatccactatgagactaccggacctgagatatggaaagg

SEQ ID NO: 1585 - DNA, 894 bp, Artificial
  Synthetic
attgtatctagcctgaaaaagagggaagatagagatagcttgagcaaatagcaatggcgactttcatcaacaatcccttgacttcactctgttccaacaccaacaagtctgaagctaatctcttcagaatttgccctttaagggctcagactttggggatttccaagtttatccccaacagaaaggttactttcccttctattgtttgcaaagcagtgtctgtgcaaccaaaatcagccactgaagttgaaggacttaacatcgctgaggatgttactcagcttattgggaacacaccaatggtttaccttaatacaatcgttaaaggttgtgttgcaaacattgctgctaaacttgagattatggagccatgctgcagtgtcaaggacaggatagggttcagtatgatatctgatgctgaggaaaagggacttatatctccggggaagactgttctagtggaacctacgagtggaaacacaggcattgggcttgccttcattgctgcttccagaggatacaagctcatcttaacgatgcctgcttcaatgagtcttgaaagaagggttcttttgaaagcttttggagctgaacttgttttaactgacccagccaaagggatgaaaggagctgtttcaaaggctgaagaaatattgaataacacaccagatgcctatatccttcaacaatttgacaatcccgcaaaccccaagatacactatgaaacaacgggcccagagatctgggaagatacaaaaggcaagatagacatacttgttgcaggcattggaactggcggaaccatttcaggagcagggcgattcctgaaagagcaaaatccaaacattaagattattggtgtggagcccacagaaagtaatgtactatcagggg

SEQ ID NO: 1586 - DNA, 946 bp, Artificial
  Synthetic
cccacgcgtccggcgggagaaaagaatggaattgcgaaggatgtaactgaattgatcggtaacactcctttggtgtacctgaataatgttgtggatgggtgtgttgctcgcgttgctgccaagctcgaaagcatggagccatgctctagtgttaaggataggattggttatagtatgattacagatgctgaggagaatggcctgatcaaacctggcgagagtgtcctcattgaacctacaagtggaaacactggagtaggattggcatttatggctgctgctaaaggctacaaactcatcataacgatgccttcttcaatgagtcttgagaggagaattattttgcgtgcttttggtgctgagttggtgcttaccgatccagcaaaagggatgaaaggttctattcagaaggctgaagagattaaggccaaaacacctaactcctttattcttcagcaatttgaaaaccctgcaaacccaaaggtacactatgagacaactggtcctgagatctggaaaggctcaaacgggaaagtagatgctctcgtctctggaattggaacaggaggcacaataacaggttcaggcaagtatttaagagagcagaaccccgacataaagctctatggtgtggaaccagttgaaagtgctattctttctggaggaaatcctggtccgcataagattcaggggattggtgctggtttcattcctggtgttttggaagttggtcttattgatgaagtaattcaagtttcaagtgaagaagccatagaaactgcaaagcttctggcattaaaggaaggtttgcttgtgggcatatcatctggtgcttctgctgctgcagcaatcaaacttgctaagcgccctgaaaatgctgggaagctgattgttgttgttttcccaagcttcggggagcgatatctttcctctgtgctctttgaat

SEQ ID NO: 1587 - DNA, 1037 bp, Artificial
  Synthetic
cacgcgtcgattggaggctggaatggctcaagaggttgccaagggtcacgaattccagtccatggacgctgggctcaagtcgctgggcatggatggcgccgccaagcccggggttctgcgccgccgcgcatcgcccgagcttcgatcggacttctcgggaggtaagctcagcgccgggctggccaaagatccggcgctcaaggatggcgaattgtccggcgtcaatatcgctgaggatgtcacacagttgattggaaaaactccaatggtctatctcaacagcgtggtggaaggatgtgtcgcaaacattgctgcgaagctggagaccatggagccatgctgcagcgtgaaagatcgtattggcttgagcatgatcgccgacgccgaggccaaaggagccatttctcctggaaagagcgtcctcgtggagcctacgagcggcaacactggaattggtttggcattcatcgctgctgccaagggctacaagctgatcctcaccatgccggcgtccatgagcatggaacgtcgagttctactccgcgccttcggtgccgagctcgtcgtcaccgatcctgccaaaggaatgaaaggagccgtttccaaggccgaagagatcgtcaacaagacaccaaacgcgtacatgcttcagcaattcgagaatcctgctaatccgaaaatccatttcgagaccactggacccgagatctgggaagatacacgcggaaaaatcgatatccttgtttcaggaattggaaccggtggtaccgtgactggtgccggacggttcctcaagagcaagaacccgaatatcaagcttgttggtgtggagccgactgagagcaatgtcttgtccggcgggaaaccaggggctcacaagattcaaggaatgggagctggattcatacccggcatcttggacgtcggaattcttgacgaggtggtggagatatccagcaacgaggcagtagagatggcgaagcagctcgcgctcaaggaaggcctgcttgttggcatctcgtcgggagctgctgttg

SEQ ID NO: 1588 - DNA, 685 bp, Artificial
  Synthetic
ccacgcgtcgaagaaaagaatggcgactggcgctgctgccgcgggtggaatcagcgtggttctggggaatgccgggtgcggcaggagagagccagcggtcgcggtggcgatgcagcgccggatggtcccgtcaatgctccggatccagcgagggaagattgtgacgtcgcccagggcgaggattgcgatctcggctgtctctacagaggtccagcaagaggctgccgatgctgagccggaagaggggctcaacatcgcggaagacgtgactcagctcatcgggaagacgcctatggtctacttgaacagtgtcgtcgatggttgtgttgcgaacgtcgctgccaagctggaaatcatggagccatgctgtagcgtgaaagatcggataggatacagcatgatctctgatgccgaagagaagggagcaatcactcccggcaagagtgtactggtagagcctaccagtggcaacacgggaattggactggcattcatagctgcggcgaaaggttacaagctcattctaaccatgcctgcgtccatgagtctcgagaggcgtattttactgaaggcctttggtgctgagcttgtcctcaccgatcccgccaaaggcatgaaaggtgcagtgcagaaggctgaggaaatactgaagagaactccaaattcttacatgcttcaacagttt

SEQ ID NO: 1589 - DNA, 465 bp, Artificial
  Synthetic
  misc_feature (106)..(106): The residue at this position can be any nucleotide.
ggcggaggaggagaggggcttcgaactctgtggcgagtcttcggagaagggggagggagaatgagtcttcagagcgtgagcacgcgagtggggaagtacgagctgngaagaacccttggagagggaacatttgcaaaggtcaaattcgccactaataccgattctggtctttccgtcgccatcaaagtccttgataaggataaaatcctcagacacaagatggtcgaacagataaagcgtgaaatttcgacaatgaagctgatcaggcatccaaatgttgtacagttatatgaggttacagctagcaaaacaaaaatctacattgttctggaactcgtcactgggggcgagttgttcgataaaattgttcatcatggaagacttaaggaggatgatgcgaggaggtatttccaacaacttatcaatgcggttgatttttgccatagcagaggagtttgtcacagg

SEQ ID NO: 1590 - DNA, 652 bp, Artificial
  Synthetic
  misc_feature (570)..(570): The residue at this position can be any nucleotide.
gtgaattgttcgcgaaggttgccaaaggaaggttaagagaagatatagcacgtggctattttcagcaattgatttcagctattgatttttgtcatagccgcggagtttatcatagggatttaaagcctgagaatttgttgttagatgaagaaggtaatcttaaggttacagattttgggcttagcgcgttttcggatcatttaaggcaagatggtttgttgcatacaacttgtggtacccctgcttatgttgcacctgaagtaattggtaaaaatggctataatggtgcaacagctgatatttggtcatgtggtgtaattctttatgtacttatagctggttttttaccatttcaagacgagaatattatggctatgtataagaaaattcataggggtgattttaaatgtccaccttggttttcatcagatgcaagaaagttgataacaagaatgttggatccgaatccgagtactcgaatcactgcttcaaaaattatggattcctcttggtttaagaaatctatgccaaagacattgaagactaaggaggaggaagaatttggcgtangaaaggcgaaaatgattgagtctttaaatgcttttcatatcatatctttatcggaggggttcgatttatcacctttgtttga

SEQ ID NO: 1591 - DNA, 615 bp, Artificial
  Synthetic
cctgcattccatgaatctagttacaatctttacattaacccaaatgccgaactaatcccttaattttcccaatcctttcttcttcaatttcataccaccgcttctctgcatagctcttctctttacgttgcttttcaacgcagcttcatcgctccacgccggaaaatggatggatcaacagtccaaggtgggagcagcgtggagtcatttctgcggaactataagcttgggaaaactcttggcattggatcattcggaaaagttaaaatagctgaacataccttaacagggcataaagttgctgtcaagattctcaatcgtcggaaaatcaagaacatggatatggaagaaaaagtgagaagggaaattacaatattgagattgttcatgcatcctcacatcattcggctgtatgaggttgtagagacaccatcagatatatatgttgtgatggagtatgtgaaatctggtgagctgtttgattacattgtggagaagggcaggctacaagaggatgaagctcgtaaattcttccagcagataatctctggtgtggagtactgccacaggaacatggtggttcatagagatcttaagcctgagaacctccttttg

SEQ ID NO: 1592 - DNA, 1287 bp, Artificial
  Synthetic
gaaaaataccattgattctctggttttttcctgtaaaccctagctaaaaaataccttaattctctttcgggaatgcagagagatgagaggttatcggttttctgatccccttttgactgccggaaaaatccaaaaaccagtcgccggcggcaggaattgccaccggaaacacgtagaagacgggtgaatcaatcacccattttcccccctttctgtcaaccatttccttttttctttacagaaacagacacccttttcattctttagcctcttttttacaaatttaaccaaaatctttctctgttccaaaaaatggcacctgaggagaaatgcatggctttgtacggaaaatacgagctcggccgccttttaggccatggaacttttgccaaagttttccatgcacgtaacgtgcaaaatggcaaaagtgtggctatgaaagttgtgggcaaagaaaaagtgattaaaattggtatgatggatcaaatcaaacgagaaatctctgttatgaaaatggtaaaacacccaaatatcgttgagcttaacgaagtcatggcgagtaaaacaaagatttacttcgccatggagttcgttagagggggtgaattatttgcaaaaatagccaaaggcaggttaagggaagatgtggctagaggctattttcagcaattaatttcagctattgatttctgtcatagccgtggtgtttatcatagagatttaaagcctgaaaatttgttggtagatgaagaaggaaatcttaaggtaacagattttgggcttagtgcatttactgaccatttaagacaagatgggctattacatacaacatgtggaactcctgcttatgttgctcctgaagtgattattggtaaaaaaggctatgatggtgcaaaagctgatatttggtcatgtggtgtaattctttatgttcttttagctgggtttttaccatttcaagatgaaaatattatggctatgtataaaaaaatttataggggtgatttcaaatgtccaccttggttttcatcagaggctagaagattaatcaccaagatgttggatccgaatccaaattcaagaatcactacttctaagattatggagtcaacttggtttaaaaaatcactgccaaagattttaagaaccaaagaggaggaagaattttctataggagatgatataaattgtgtcgaaaaggctaaagatctcgagacattaaatgcgtttcatatcatttctttatcagaaggtttcgatttatcgccattatttgaagagaagaag

SEQ ID NO: 1593 - DNA, 644 bp, Artificial
  Synthetic
ttaatccattctataacaatcacgcctccatcccaaacaaacggagaccgccaattcgtaatccttacggattgtgaggaagttttattgggcacaatggcgacgattccccaagaataaataaaaaaattctcaattgtaacgccaatctcttctccaagatgaccaacaagaacgagaagaaaggctacattttgatgcaaaggtatgagattgggaaattgttaggccaagggacatttgccaaggtgtaccatgcaaaaaatctgaaaactggccaaagtgttgctgtaaagatcattgacaaggagaaggtgatgaaagttggcttaattgatcaaatcaaacgtgaaatctctgtcatgaggctaatcaaacacccaaatgttgtccagctctatgaggttatggctagcaaaactaagatatatttcgccatggaatatgtcagaggtggtgaacttttcaataaggttgctaaaggcaggcttaaagaagatgcagctagaaaatacttccaacaattaatcgctgcagttgatttctgtcatagccgtggcgtctaccaccgtgatctcaagcctgaaaatctcctcctcgacgaagatggaaacttgaaagtgtcagatttcgggctgagtgca

SEQ ID NO: 1594 - DNA, 1032 bp, Artificial
  Synthetic
ctcaaacatagcctttcgtattcagcttctcatatactcttcgatctgaatagtttattataatatttgagttctctttaatcttttttaatctttttattttggaaaagtttaagatgagtgtatccaagtcccaggtttggcaaccttgtaaaaagaagaggatttagcttaaggcttaatccagaagtaaaaaaaataaaagaagatttttttatagggaagaaaaaaaagaggatggtctttgtattgatttagggtagggatttaataagattgtaggatctgtaagaaatagaaagtttggagatagatgggttcaagatcaaataatggaagtgggaggactacagtgggaaggtatgagatagggaggacagttggggagggtacttttgcaaaggtcaaatttgcaaggaatgttgagactggtgataatgttgccattaagattcttgataaagagaaggtcatgaagcacaagatgatcggccagattaaacgggaaatatcaacgatgaaacttataagacaccccaatgttatccgaatgtatgaggtcatggccagcaagacgaagatatatattgttttggaatttgttactggtggcgaactgtttgacaaaatttctagtagaggtaggctcaaagaagatgaagcaagaaaatactttcagcaacttataaatgcagttgactactgtcatagtagaggtgtattccacagagatctcaagcctgaaaacttgttgctggatgcgaatggtgttcttaaagtttcagattttggactgagtgcgctacctcagcaagttcgcgaagatggactactacatacaacatgtggaacaccaaattatgtggcccccgaggtgatcaacaataaaggttatgatggagctaaggctgacctgtggtcatgtggtgtaatcctttttgtacttatggctggttatttgccttttgaagagtcaaatctcatggcactatataagaagataccataaagctgaattttacatgtccaccc

SEQ ID NO: 1595 - DNA, 675 bp, Artificial
  Synthetic
ttgtgaagcttttggcgcattcccagcggccgggcgagggcatcgtgatctggaaagaatgcgatcctagtgccgggcacagtcgatccatcaatcgacttcggcggcggcggcggggcggcatggtgatgcgcaaggtgggcaagtatgagatcggtcggacgattggcgaaggtacgtttgccaaggtcaagttcgcgcaaaacaccgagaccggggagagcgtcgccatgaaagtgctcaacaaggagacgatcctcaagcacaagatggtcgatcagatcaagcgagagatctctatcatgaaacttgtgcgtcacccttatgttgtccggcttcacgaggttcttgctagcagaaccaaaatctacatcattttggagtttgttaccggtggagagctgtttgacaaaattgtggatcaagggagacttagtgagaatgagtcgcgcaaatactttcagcagctaattgatgctgtggactattgtcacagcaaaggagtttatcaccgagatttgaagcctgaaaatcttctccttgattcgcaaggaaatttgaagatatcagatttcggcttgagtgctctgccgcaacaagaagatggacttcttcatacaacctgtggaactccaaattatgttgctccagaggttcttgataacaagggttatg

SEQ ID NO: 1596 - DNA, 391 bp, Artificial
  Synthetic
aattcggcacgaggtaaatgatgggcggatgaaagaagatgaggcgcggagatatttccaacagcttatacatgctggggactactgtcatagcagaggggtctaccatagagacctcaagcctgaaaatttactattggactcctatggaaacctcaagatctcagattttggattaagtgcttttgtcccaacaagtcagggatgatggactcttgcatacatcgtgtggaacaccaaactacgttgctcctgaggttctcaatgatagaggctatgatggagcaacagctgacatgtggtcatgcggtgttgcactctatgtcctgcttgcaggctacttaccttttgatgattctaaactaatgaatctttataaaaaaatatcatc

SEQ ID NO: 1597 - DNA, 358 bp, Artificial
  Synthetic
atgaagcttcttaaccattcaacattgtccaaatacacgaggtgattggaaccaagacaaagatctgtatagttatggaatacgtttcaggtggtcagctttcagacagacttggaagacagaaaatgaaagaatcagatgctagaaaacttttccaacaattgattgatgctgttgattattgtcataacagaggagtttatcatagagatcttaagccacaaaacttgttactagattcaaagggtaatctcaaagtttctgactttggattaagtgcagttcctaaatcgggggatatgctctctacagcttgtggctctccatgttatatagcaccagagttgattatgaacaa

SEQ ID NO: 1598 - DNA, 628 bp, Artificial
  Synthetic
gcaaagtgttagaaccagagtcggtaagtatgagatcggcaggacactcggggagggtacttttgcgaaagtcaagttcgccaagcacatcaaaactggacatggtgtggctatcaagattttggacagagatagggttctcaagcacaagatggtcgagcagatcaagcgagaaatttcgacaatgaaacttgtgagacatccgaatattgttcaaataaaggaggttatggccagcaagtcgaaaatctatattgtcttggagcttgtcacaggcggtgaactctttgataagatcgtccatcaaggcaggctcaaggacgacgaagcaaggaaatattttcagcagctgatcaacgcggtggactactgccacagtcgtggagtataccaccgtgatttgaagcctgagaatctgctgctagactcaagcgggaatcttaaaatatcggattttggtctgagcgctcttcctcagcaactccgggccgacggcttgctgcatactacttgtggaactccaaactacgtgtcgcccgaggtgatcaatgacaaaggttacgacggagcgaaagcagacttatggtcctgcggggttatcctttttgtcctcatggctggctatttg

SEQ ID NO: 1599 - DNA, 1021 bp, Artificial
  Synthetic
ggtgaagtctgtggggaagaaatctagggttagaaggccctgcgccaggaagcggcccaagggtagttagaaccagcacttcgcggcgcaccactgacgagttcttcgcgacttttttggtagcgtattggaatttggggcgattctagttctcgcaatggcggcaacgcccagtggcctccagaccagggtcgggaagtatgagctgggaaagacgatcggcgagggcaatttcgccaaggttcggcgagccaggaatctcgacactggcgagatcgtggcgatcaaggtcctcaacaaagaggaggtgatgaagcacaaaatggtcgagcagctcaagcgggagatttcgaccatgaagctagtaaagcatccaaacattgtccagctccacgaggttctggccagcaaaactaaagtttacatcgttttagagtacgtcactggtggagaactttttgacaagatcgtgaaacaaacccgcttgaaagaagacgaagcaaggaagtatttccagcaactcatcaatgcagttgactattgccacagcaggggtgtgtatcaccgcgacttgaagccggagaatttgcttctcgataaaaatggaaacttgaagatctctgacttcggtttgagtgcgcttccgcaacatcttcggccggatggtctacttcacactacttgcggcactccaaactacgtagctcctgaagtcataaacaacaaaggatacaacggggccactgcggacttgtggtcgtgcggtgtgattctttacgtcttgatggctggatttttaccttttgaagagcccaacctgatgaatttgtacaaaaagatcttccgcgcggatttcaagtgtccaaagtggtttagcagtggggcgaagaacctgatttgtaaaatactgcatccaaatccaaaatctcggattacgattccacaaattctcgaggacgagtggttcaaggtgggctacaagccagcaaagttccttgaggaagatgctgctcatctgaaa

SEQ ID NO: 1600 - DNA, 416 bp, Artificial
  Synthetic
tcgaccacgcgtccggccgctcggccggctcctcggccgtggcacgttcgccaaggtctacaaggcctataagttggccaccggcgaggccgtcgccatcaaggtgttcgacaaggaggcggtgcagcggtccggcacggtggagcaggtgaagcgcgaggtggacgtcatgcggcgtgtgcaccaccgccacgtcatccgcctccacgaggtgatggctacgcggtccaggatctacttcgtcatggagtacgcgagcggcggcgagctcttcacccgcctctcccggagcccgcggttcccggagcccgtcgcgcgccgctacttccagcagctgatcaccggcgtggagttctgccacagccgcggcgtgtaccaccgcgacctcaagcccgagaacctcctcctcgacgccc

SEQ ID NO: 1601 - DNA, 655 bp, Artificial
  Synthetic
gaattcgaatctcatcacttatctctctctcaatctctcttttaaatttcaaaaagttcctgaaagaacttcaaaaccatattgagatcttagaaccccaggagaaaaaaatacattcagcgagcgaattgattgatttttcaaatcaattcgctcgtattctggtttatttcagattaacgaatctatttcttgtttgttgaaattatatcaatcacgcatgcctgaattaatcgagatctcatcagaaaattcattatttggcaaatatgagctcggtaaattgcttggttgtggcgcattcgctaaagtttatcacgcaaggaatatcaaaacagggcaaagcgtagcaataaaatgtataagcaaacagaaaatcctcaaaggaggattaatggcacatgtcaagagagaaatcactattatgcgtcgtctccaccataagaatattgtgaagctttatgaagttttggccacgaaaacaaagatttatttcgttatggaatttattaaaggtggtgaattgtttgctaaagtagctaaaggtaaatttagtgaagatttgagtcgtaaatatttccagcaattaatatcagctgttggctattgtcattctcatggtatttttcacagagatttgaaacctgaaaatcta

SEQ ID NO: 1602 - DNA, 641 bp, Artificial
  Synthetic
ccccccggctcctccaacctggctcagtggcctcctgttcttgagagaactgaatctgctgtccagctgctgctccggctggtctctgagttgaaggtacttgaataacttgaaggttcctaggaaccttcatttgttggaagatgtatagggctaagagggctgcattatctccaaaggtgaagcgccgtgtagggaagtatgagctcgggcgcaccattggagaaggaacctttgcaaaggtccggtttgcgaagaacactgaaaatgacgaaccagttgctatcaaaatccttgacaaggagaaggttcagaagcacagattggttgaacaggcgtgaaatttgtactatgaagttagtaaagcatcctaatgttgttcggctgttcgaggtcatgggaagtaaagcaagaattttcattgttctggaatatgttactggaggagagctctttgaaatcattgcaactaatggaaggttgaaggaggaggaagcacgaaaatactttcaacaacttatcaatgcagttgactactgccacagtaggggtgtgtaccacagagacttgaagttagaaaatttgctgcttgatgcttctggaaacctgaaagtatctgactttggtttgagtgctttaac

SEQ ID NO: 1603 - DNA, 467 bp, Artificial
  Synthetic
tgcagaggagggaggatcttcttcacagcctttcttagctcacaaggtttttgatttttaggtgaaggaaaaaaagatatagaagtttgcctcgaaaatataccctctacttggaagtgagaaacgcttctcccgctggttctctaagacggcgcaaatgcctgaaagatgctctagcagtagcagtcaaagtgttaaaacaagagttggaaatttcgagctcggccgtgttcttgggcaaggcacctttgccaaggtgaagattgccaaaaatgttgtcaccagccagattgtggcgattaaaatcctcgataaagagagagtgctcaaagacaatctcgttaatcagattaaacgggagatttcgacaatgaagctggtgaagcaccccaacgttgttcaactctatgaggttacagcaagcaaaagcaaaatctattttgtgctagagtatgtcactggaggcg

SEQ ID NO: 1604 - DNA, 814 bp, Artificial
  Synthetic
cccacgcgtccgctcttgtctctctcggtttcggatccgtcggaagctctttaatccccaacaagtgcttgttaaagcaaaataattgggatgcagaaggatggggttatatagcagcgattaccttttggaggctactaaatttcagtgtgcattgttgttagtcttcctcatccttcgtgatctcaaatatgcagctcacggcacacttaacttctcgtgccagatgcacaatgaagcgacaacccttatacatctcgtcatgctgaagcacagtcttgtcggagacggttgagctccgtaacaaggcctcctgcctgttacaaacgagcatcatcacagcaggagaaagttacttgtagttgttactaggattgtcgattcaaatggaggagaagaaaggaaatgttttgatgcaaaaatatgagttggggagattattaggtcaaggaaattttgctaaggtttattatggaaggaatcttgaaacgggacagagtgtagccatcaaggtaattgataaagagaaggttctcaaggccggactgatcgaacagactaagagagagatatctattatggcactggtcgaacacccaaatgttctacagctatacgaggttatggcaactaaatctaagatttacttagtgattgaacaagccaaaggcggggagcttttcaaaaaattgacaaaggggagactcaaggaaaatgtagctaggaagtactttcaacaattgattagtgctgttgagtgttgccacaaccaagatgtttatcaccgtgatctgaaaccagaaaatgtgctgct

SEQ ID NO: 1605 - DNA, 641 bp, Artificial
  Synthetic
gagcaatagaggggtggaatgatggctagtgtttcttctgtaccaattccggcttcttctctctcaagctcgtttagggtatcccggccactgtccttcatggttccctcttccgcctcctcgtgcccccctttgccctcgataacctgcgcattggcttctgaaggcgctgtccgcatccagaaccttcctcgccctgattcctctggtcgcttcggcaagtttggaggcaaatatgtccctgaaaccctcatcgctgccctcgatcaactcgagaaggcttactctgaagtcactaatgattcttcgttccagcaacaactttctagtattctcaaggattatgttggacgagagtcacctctttatttcgccgaaagattaacggaacattacaaaaatagctctggtgaaggtcctctcatatatctgaagcgagaagatctgaaccacacaggtgctcacaagatcaataatgctgttgggcaagctttactagcaaagtggattgggaagaaacgcatcattgcagagacaggcgccgggcagcacggtgtagcaactgcaacagtttgtgctcgctttggcttgaattgcgtcatttatatgggtgcccgagatatggagaggcaatccttgaa

SEQ ID NO: 1606 - DNA, 569 bp, Artificial
  Synthetic
gaattcacttgtaaatggctttctcatcctccactgttacttgcaaaaaccctaattccaatctccttcaaaaaccatacttttcttcgtcttcttcctttaatcctttacgagttcatttccagaaatttcctttaccttcttcttcttccattaaaagttcttcaatttcttgtgcagtaaccgaagagaaacccaaaatgtcgactgtttcgcagagacctgattcttttggtaggtttgggaaatttgggggaaaatatgttcctgaaacactaatgtatgcacttacggagcttgaatctgcgtttcggtcattggcggcagaccaagattttcaggaagaattgagtggaattttgaaggactatgttggtagggagacacctctttactttgcagagaggttaacggaacactataagtctgctaatggtgaaggacctcatatatatcttaaaagggaagatcttaaccacacaggtgcccacaaaatcaacaatgctgttgcccaagctttacttgcgaagcgattggggaaaaaacggattatagctgagactggagct

SEQ ID NO: 1607 - DNA, 658 bp, Artificial
  Synthetic
ggcacggcggcggcgtcacggcgattcattgcttctcctccttccgatcagctcggcacggaggtggagttgccggcgaggatcaatctgccgcggcgcagcgttcgggcagcgatctcgtcccagggcgccgtggcgccggcggaggcggaggacgtgttgcatgccgagtatggagggttccagcggccggatgcgtttggaaggtttgggaaattcggtggtaagtatgttccggagacgctcatggcggcgctggcggatctggaggccgcgtatcgattgcttgttggcaagcccgaatttcagcaagaattggctggtattctcaaagactacgttggacgagagtctccactctactttgccgagcgcttgacgcagtactacaagaacgccaatggcagtggacctgatatatatctcaagcgagaagatctaaaccacaccggtgctcacaagatcaacaatgccgtcggccaagccttgctcgccaagcacattggcaagaagcgcatcatcgccgaaactggagccggccagcacggagttgccacggccactgtctgtgctcgctttggactggaatgcgtcgtttacatgggtgcacaagacatggaaaggcaagctctcaacgtgtatcgtatgcggcttctcg

SEQ ID NO: 1608 - DNA, 678 bp, Artificial
  Synthetic
aacattttattgattcttatcatccaaacatggccttctcctcctccactgctcaaacagcttcacctctatcctccaaacattgttcccgcctatcttcctccgccgcctcctcctcctcttacttccctaaatttcaaatacccttcaaattcaacgaaattacatcttgcccttcctcaatttcctgtgtccttaccaaacaggaatcaatggcggctcgagaggctgctgaaccggcggttcccctgcgtcctgattcgtttggccggtttggtaaatttggcgggaaatacgtacctgaaaccctaatgcacgctcttgacgagctcgagaccgccttcaaattgctcgctaccgatgaagcttttcagaaagagctagatggaatattgagagattatgtaggcagagagagccctctttattttgcagagagacttactgagcactacaaacgtccagatggccaagggccattgatctacctgaagagggaggatcttaaccacactggtgcccacaaaatcaataatgcggttgcccaagctttgcttgccaagcgcttgggcaagaagcgcatcattgctgagacaggggcaggtcagcatggtgttgctactgctactgtttgtgctcgctttggtttggaatgtattatctacatgggtgctcaag

SEQ ID NO: 1609 - DNA, 632 bp, Artificial
  Synthetic
cccacgcgtacggcgtattgagatagaaaactttttaaaaaggtgcaaaaaaagaagaaaaaaaaactaaaagggataggggctgagtaaaataatctgtggttctttgttagatttcctctgttttgaatctcaacacagagccatggcaaagttttccaagaattccatggttctgtgcttttggttagtcatagtttttgtaatctcttgtgcaaatggtgttaggcttaagaaatttgatcaccccactaaaggtgatggcactcttaacttcttggttattggtgactggggaagaaagggtaccttcaatcaatctcacgtagctcacaagatgggaagaatcggagaggatctaaacattgattttgtagtatcaactggtgataatttctatgataacggattgacaggggtgcacgatccaaattttgtagagtcatttactaatatatatacagcaaagagtttacagaaacaatggtatagtgtattaggcaatcatgattacagaggaaatgtataagcgcaactcagtccttaccttaggaaaattgatagaagatggctttgtttaaggtctttcatagttaatgcagaaattgctgaaatattcatggtggatacaa

SEQ ID NO: 1610 - DNA, 453 bp, Artificial
  Synthetic
acggttccgttagttttatagtcatcggagattggggtcgtcgtggctccttcaatcagtctctcgttgcttatcagatgggaaaaattggagagaagattgacttagatttcgtggtgtctacgggagataacttctacgacaatggattgtttagtgaacatgatccaaacttcgaacaatctttctctaacatctacactactaagtcttcagaaacagtggtacagtgttttgggaaaccatgactatagaggtgacgcagaagctcagctgagttctgttctccgggaaatcgacagccgttggatttgtcttcgatcatttgtcgttgatgcagagttggtagagatgttctttgttgacacgactcctttcgtgaaagaatactacacagaagcagatggtcactcatatgattggcgcgcagttccatctcgcaactcttatgtc

SEQ ID NO: 1611 - DNA, 707 bp, Artificial
  Synthetic
gatttgattcaagctctaggcgtttaagtagatggatgcgtgattgattgaatggaagcgatagacaagctagatctagcttgatcttcactgatagaggaagaggaggaagggaagatcaaggatggctcctgacgaggaatcggcgctcttggggacaaatagcgatcatcacagcaagcgcaaattccggcgcaaagtcgtcgctacaagctgtgttcttgggatctttctcgttctcactactgtttggttccttgaccgtggcggcttcttagaattctacgctggtcaggcgatagaatcgtcgaatcctctggtctcgccggtcgatcgtgtagctccagtgaacttcttagcgataggggattggggacgacatggattgtataaccaaacgttggttgcttcccagatgggaaaagttggcgaggagctcggcatagatttcgtggtctcggtgggagataatttttataagaatggattgactggcgtggacgacattgcgtttgatcaatccttctcgaacatctacactgctccaggccttcaaaaaccatggcatgcagtgctgggaaaccatgactatcatggagttgttctcgcacagcttgatcaccggctagctttgcgtgattggagatggcactgcgtcagaggtggacaaattatttatgatctgagctcatctctttctcgaggat

SEQ ID NO: 1612 - DNA, 704 bp, Artificial
  Synthetic
atttgattcaagctctaggcgtttaagtagatggatgcgtgattgattgaatggaagcgatagacaagctagatctagcttgatcttcactgatagaggaagaggaggaagggaagatcaaggatggctcctgacgaggaatcggcgctcttggggacaaatagcgatcatcacagcaagcgcaaattccggcgcaaagttttcgctacaagctgtgttcttgggatctttctcgttctcgctactgtttggctccttgaccgtggcggcttcttagaattctacgctggtcaggcgatagaatcgtcgaatcctctggtctcgccggtcgatcgtgtagctccagtgaacttcttagcgataggggattggggacgacatggattgtataaccaaacgttggttgcttcccagttggcgaggagctcggcatagatttcgtggtctcggtgggagataatttttataagaatggattgactggcgtggacgacattgcgtttgatcaatccttctcgaacatctacactgctccaggccttcaaaaaccatggcacgcagtgctgggaaaccatgactatcatggagatgttctcgcacagcttgatcaccggctagctttgcgtgattggagatggcactgcgtcagaggtggacaaattatttatgatctgagctcatctctttctcgaggtaattatata

SEQ ID NO: 1613 - DNA, 363 bp, Artificial
  Synthetic
ggaggagggtgagttctctgaggcccgcgaggatctcgccgcgttggagaaggactacgaggaggttggcgctgagtccgacgagaatgaggatggcgatgatggtgacgagtactagaggagtcgtcgtcgtctgggggctcgatgttctgtgtgtcaaggcctgattgataactgctgctatcccatgatctgccagtgtggagttatcctgttgccgtgtgcgtgtgtcttcgagacatttgcttgtggtgatctgatgtttggggcttaatgggcttacaaccctcgttgttgtaacctgtgtgccttgtgtaatgtgagaccgcttcgtcacttataatatgcgcgtttgttcaattt

SEQ ID NO: 1614 - DNA, 784 bp, Artificial
  Synthetic
cccacgcgtccgcccacgcgtccggctttcctcctacgccccggtgatctcggccgagaaggcctaccacgagcagctctccgtggcggagatcaccaacagcgccttcgagccgtcctccatgatggccaagtgcgacccgcgccacggcaagtacatggcgtgctgcctgatgtaccgcggcgacgtggtccccaaggacgtgaacgccgcggtggccaccatcaagacgaagcgcaccatccagttcgtggactggtgccccacggggttcaagtgcggcatcaactaccagccgcccagcgtcgtcccggggggagacctggccaaggtgcagagggccgtgtgcatgatctccaactccaccagcgtcgtcgaggtgttctcccgcatcgacatcaagttcgacctcatgtactccaagcgcgccttcgtccactggtacgtcggcgagggcatggaggagggggagttctccgaggcccgcgaggacctcgccgcgctggagaaggactacgaggaggtcggctccgagttcgacgatggtgacgagggtgatgagggtgacgagtactagagaggttcagggttcttgcctggtgccttggcaatgcttgattactgctgctatcctatgatctgtctatcagtttgtgtgtctggttttgaaaaacatttgcttttcgattatgcagggtttgcttgtagctttcgctgctgtgacctgtgttgtttatgtgaaccttctttgtggcatctttaatatccaaatgagtggtttgtc

SEQ ID NO: 1615 - DNA, 632 bp, Artificial
  Synthetic
aacagtgccttcgagccatcctccatgatggccaagtgcgaccctcgccacggcaagtacatggcctgctgcctcatgtaccgcggcgatgtcgtgcccaaggacgtgaacgccgccgtcgccaccatcaagaccaagcgcaccatccagttcgtggactggtgcccgacggggttcaagtgcggcatcaactaccagccgcccagcgtcgtccccagcggcgacctcgccaaggtgcagagggccgtgtgcatgatctccaactccaccagcgtcgtggaggtgttctcccgcatcgaccacaagttcgacctcatgtactccaagcgcgccttcgtccactggtacgtgggtgagggcatggaggagggtgagttctctgaggcccgtgaggatctcgccgcgttggagaaggactacgaggaggttggcgctgagtccgacgagaatgaggatggcgatgatggtgacgagtactagaggagtcgtcgtcgtctgggggcttgatgttctgtgtgtcaaggcctgattgataactgctgctatcccatgatctgccagtgtggagttatcctgttgccgtgtgcgtgtgtcttcgagacatttgcttgtggtgatctgatgtttggggc

SEQ ID NO: 1616 - DNA, 307 bp, Artificial
  Synthetic
cgccgcgctggagaaggactacgaggaggtcggctccgagttcgacgatggtgacgagggtgatgagggtgacgagtactagagaggttcagggttcttgcctggtgccttggcaatgcttgattactgctgctatcctatgatctgtccgtgtgggcttctatctatcagtttgtgtgtctggttttgaaaaacatttgcttttcgattatgcagggtttgcttgtagctttcgctgctgtgacctgtgttgtttatgtgaaccttctttgtggcatctttaatatccaagttcgtggtttgtcgt

SEQ ID NO: 1617 - DNA, 372 bp, Artificial
  Synthetic
gtactccaagcgcgccttcgtccactggtacgtcggcgagggcatggaggagggggagttcgccgaggcccgcgaggacctcgccgcgctggagaaggactacgaggaggtcggctccgagttcgacgatggtgacgagggtgatgagggtgacgagtactagagaggttcagggttcttgcctggtgccttggcaatgcttgattactgctgctatcctatgatctgtctatcagtttgtgtgtctggttttgaaaaacatttgcttttcgattatgcagggtttgcttgtagctttcgctgctgtgacctgtgttgtttatgtgaaccttctttgtggcatctttaatatccaaatgagtggtttgtcgt

SEQ ID NO: 1618 - DNA, 692 bp, Artificial
  Synthetic
tctctctctctctctctctccctctcgctcatcgtcagctatggcgatggctgcgacctcgcacatctcctcggctacagcctgcactctccactccaagctatcggccacccgcaatggggtttacagctcacaaaccctggcctttgcacccctcggcgaggccatagtgacacgtcggagtggtcgaggaaagattgtttgccaggctgccatcccgtctcgtgtcccagacatgggaaagcgccaattgatgaacctacttctccttggtgccctctccctccccactgctggattgcttggtccctacctgactttctttgttcctccaagctctggatctgggggagctggtataattgctaaggatgcccttggaaatgatatagagttggcagcatggctcaagactcaccctcctggtgatagaacactcagccaaggcctcaagggtgatcccacctacctggttgttgaatccgacggaattcttgcaacctatggtatcaatgcagtttgcacacatttgggttgtgttgttccatggaatcctaatgagaagaaattcatttgcccttgccatggatctcagtacaacagccagggcaaggttgtgcgaggtccggctcctttgtctcttgccttggcccacgctgatgtatcggatggccagatcctgttctctccct

SEQ ID NO: 1619 - DNA, 969 bp, Artificial
  Synthetic
cggacgcgtggggtggacaccatacatccgcttcacaagttgcttacccccacccccaggtctcatcaacgatcactaatatcactgctaccttcctccgaatatctttttctcagaacattcagaaatggcttcttctactctttctcacgtaactcagctatgctcgagcaagagcggtttgtcttcggtttcacaatgtttgctactgaaaccaatgaagattaacagtcatggattgggaaaggataagaggatgaaagtgaaatgcatggctacaagtattccagcagatgatagagtgcctgatatggaaaagaggaatctaatgaatttgcttcttttgggtgctctttctctacccactgctgggatgttggtaccttatgctactttctttgcaccacctgggtcagggggtggtgggggtggaatccctgccaaggatgcattaggtaatgatgttattgcatctgaatggctgaaaactcatgcacctggcaaccgaactctcacgcaaggactaaagggagaccctacttaccttgttgtggagaatgatggaacacttgcaacctatggtattaatgctgtctgtactcaccttggttgtgttgtgccatttaatgctgctgagaacaagtttatttgcccgtgccatggatctcaatacaacaaccaaggaagagttgttagaggacctgctcctttgtccttggctttggctcatgctgatattgatgatgggaaggtggtgtttgtcccatgggttgaaacagacttcagaactggtgaagctccatggtgggcttagatctcccatttaagcttaattacagtatcctcttgtatctttgttacataaagcttatccctttttatgaagaaaaaaaatatatatacattttgagatgtaactattgaagcataaccttggcagtcccataatgacattttttgtttgggata

SEQ ID NO: 1620 - DNA, 822 bp, Artificial
  Synthetic
gaattcaaactctagttcacctcacactaaaccatggctgcttctacactttcccctgcaactctttctcaggtatgttctggcaatgggatgttttctccttcacaaggaaaacccaccaggacccaattgatggttaaagaaaggggaatgaagattgtttgccaggcttcaagtattcctgctgaaaatgtacctgacatgggtaaaagagagctcatgaatttgctactcttgggtgctctttctctccctactgctggaatgctagttccatatggttccttcctcgccccccctggctcaggaagtggagctggtggacaaacagcaaaggatgccttgggtaatgatgtcattgcagctgaatggctcaagacccatggaccaggaaacagaaccctaactcagggattgaagggagaccctacttacctagttgtggagaacgacaaaacacttgcaacatacggtatcaatgcagtctgtacccatcttggttgtgtggttccatttaatgccaatgagaagaagtttatctgcccttgccatggttcgcagtacaataaccaagggagagttgttagaggacctgctcctctgtccttagcattggcacatgccgatgttgtcgatggaaaagttgtatttgttccatgggttgaaaccgatttcagaacaggcgaagctccatggtggtcttaaacatttcgcatctcttcaatatcatttccattcctccatgtaatcaacttgaactgattcaatttgtttgcttcagtggataaatacatatcatcacctgtcatacactcctgcaac

SEQ ID NO: 1621 - DNA, 765 bp, Artificial
  Synthetic
tggtatcaacgcagagtggccattacggccgggggaatacctttttctcaggaccattcagaaatgccttcttctactctttctcctgtaactcagctatgctcgagcaagagtggcttgtcttcggtttcacaatgtttgctagtgaaaccaatgaagattaacagtcatggattgggaaaggataagaggatgaaagtgaaatgcatggctacaagtattccagcagatgatagagtgcctgatatggaaaagaggaatctaatgaatttgcttcttttgggtgcgctttctctacccactgctgggatgttggtaccttatgctactttctttgcaccacctgggtcagggggtggtagtggtggaacccctgccaaggatgcattaggtaatgatgttattgcatccgaatggctgaaaactcatgcacctggcaaccgaactctcacgcaaggactaaagggagaccctacttaccttgttgtggagaatgatggaacacttgcaacctatggtattaatgctgtctgtactcaccttggttgtgttgtgccatttaatgctgctgagaacaagtttatttgcccctgccatggatcccaatacaacaaccaaggaaaagttgttagaggacctgctcctttgtccttggcattggctcatgctgacattgatgatgggaaggtggtgtttgtcccatgggttgaaacagacttcagaactggtgaagctccatggtgggcttagatcaccttatctagc

SEQ ID NO: 1622 - DNA, 640 bp, Artificial
  Synthetic
ccccgggacaccctgcgctgcagccgaacgaccgagctaccgagccaatccagccatggcctccaccgcgctctccaccgcctccaaccctactcagctgtgcaggtctcgcgcctcgctgggcaagcccgtcaagggcctgggcttcggccgggagcgcgtgccgaggacggcgacgaccatcacatgccaggccgcgagcagcatcccggccgaccgcgtcccggacatgggcaagcgccagctgatgaacctcctcctgctcggcgccatctcgctccccaccgtcggcatgctcgtcccctacggcgccttcttcatccccgccgggtccgggaacgccggcggcgggcaggtcgccaaggacaagctcggcaacgacgtgctcgccgaggagtggctcaagacacacggccccaacgaccgcaccctcacccaggggctcaagggtgacccgacgtacctcgtcgtggaggccgacaagacgctggccacgtacgggatcaacgccgtgtgcacgcaccttgggtgcgtcgtgccgtggaacgccgccgagaacaagttcatctgcccctgccacggctcgcagtacaacaaccagggcagggtcgtccgtggacctgctcccctgtcgctggca

SEQ ID NO: 1623 - DNA, 563 bp, Artificial
  Synthetic
ttgagaccataaccttttagcgttttcggctaaagctttcgctgactactacaacaatggcgtcctcatccctttcccctgctactcagcttggttctagcagaagtgctttgatggcgatgtcaagtgggttgtttgtgaagccaacgaagatgaatcatcaaatggttagaaaagagaagattggattgagaatttcttgtcaagcgtcgagtattccagcagacagagttccagatatggaaaagaggaagactttgaatcttcttcttcttggggctctttctctacctactggctacatgcttgtcccttacgctaccttctttgttcctcctggaaccggaggtggaggtggtggtactccagccaaggatgcccttggaaacgatgtagttgcagcggaatggcttaagactcatggtcccggtgaccgaaccttgacccaaggattaaagggagatccgacttacctagttgtagagaacgacaagactttagcgacatacggtatcaacgcagtgtgcactcatcttggatgtgttgtgccatggaacaaagct

SEQ ID NO: 1624 - DNA, 776 bp, Artificial
  Synthetic
  misc_feature (125)..(125): The residue at this position can be any nucleotide.
atcaaagttcaatgaccatggcagccacaatctctagcgtggcttcggcagctaagctctcgtcggcacagaatggaattcactctccatcgccttcgttctcgtcgctgcctctgcttccaggnaagacgaagaagtgtacaactgtgtgccaagcagcatcggtcccggtcaatgtcccagacatgggaaagcggcagctcctcaacaaactgctacttggagcactctcgttgccgacagccgggatcctggggccgtacctctcattcttcgttccccccggctccggcggaggtggcgccggtcttatcgcaaaagacgccattgggaacgatatcatagctacagattggctcgcatcgcatcccgtcggtgatagaacactcagccaaggcctgaagggagatccaacttacctcgttgtcgagaacgatggaacgctggcaccttatgcaatcaacgccgtttgcacgcatctcgggtgtgtggttccatggaacaaagccgagaacaggtttatctgtccttgccacggttctcaatacaacaaccagggaagagtcgttcgaggtcctgcacctttgtctctagcgttggctcactgcgacatcgacaacaacaaagttatcttgagtccctggcccgaaacagactttagaacgggagagaatccatggtgggcttaaaaccaccacctttgctcgctttgctcgagacaacaatttgtaaaaggcattatcatatacccgtcttattaaataattcaagaaaac

SEQ ID NO: 1625 - DNA, 661 bp, Artificial
  Synthetic
cccctggtggacaccctgcgctgcagccgaacgaccgagctaccgagctaatccagccatggcctccaccgcgctctccaccgcctccaaccctactcagctgtgcaggtctcgcgcctcgctgggcaagcccgtcaagggcctgggcttcggccgggagcgcgtgccgaggacggcgacgaccatcacatgccaggccgcgagcagcatcccggccgaccgcgtcccggacatgggcaagcgccagctgatgaacctcctcctgctcggcgccatctcgctccccaccgtcggcatgctcgtcccctacggcgccttcttcatccccgccgggtccgggaacgccggcggcgggcaggtcgccaaggacaagctcggcaacgacgtgctcgccgaggagtggctcaagacacacggccccaacgaccgcaccctcacccaggggctcaagggtgacccgacgtacctcgtcgtggaggccgacaagacgctggccacgtacgggatcaacgccgtgtgcacgcaccttgggtgcgtcgtgccgtggaacgccgccgagaacaagttcatctgcccctgccacggctcgcagtacaacaaccagggcagggtcgtccgtggacctgctcccctgtcgctggcattggtgtacgccgacgtc

SEQ ID NO: 1626 - DNA, 573 bp, Artificial
  Synthetic
ccccccccggatgagaatggccgcgccgcagcaagtgggtgtgcgtgccgccccgctcgcgcgcgcgctccgaactcgcgtcgccgccgccgccgcgtctgcgagctctcccgaacgcgcgctcctcggcctctccgaaccagatctccggcagctcgccgtcgacctcggccagcaaagttacagggggaagcagcttcacgacctcctctacaagtccagggccaagcaaatccaagaatttagccacgtaccaaaggtgttccgtgaggccttggtcggcgctggctggaaggttggccgctcgccagtgcaccatgctgtgacggcctccgatggcactaccaagatacttctcaagttggaggataacagattgatcgaaacagtagggatccctgtcgatgatgacaaaggcccgtcaagactcactgcctgcgtttcatcacaggttggctgccccttgcgttgctcattttgtgccactggcaagggagggtttgcaagaaaccttcatgcacatgagattgtggagcaggttttgggcatagaggagacgttccaacacagggt

SEQ ID NO: 1627 - DNA, 710 bp, Artificial
  Synthetic
  misc_feature (152)..(152): The residue at this position can be any nucleotide.
  misc_feature (153)..(153): The residue at this position can be any nucleotide.
  misc_feature (606)..(606): The residue at this position can be any nucleotide.
atggaaggttggaaggtctctaattcataatgcagtcaccgcagctgatgggaccattaagttgttaataaaactcgaggacaaccgattggtcgagactgttggaattccagttaaagacaaagatggttcatctcgcttgacttaggtgnnttatctcaggtgggctgcccattacgctgttcgttctgtgccactggcaaaggaggattctcaaggaaccttaagagccatgaaattgttgatcaggtcttggcaatagaagagctattcaatcagagagtgacaaacgttgtctttatgggtatgggggagccaatgttgaacatgaaagaagtccttgaagcacatcgttgcctgaataaggatattttgattgggcaaaggatgattacgatttctactgttggagttccaaacaccataaagaagctcgcatcttacaaacttcagtcaacattggctctcagcttacatgctccaaatcagaatcttcgggaaaagattgtaccaagtgcaaagtcctaccctttgaatgcaattatgaaggattgcagggactacttcctggaaactagaagacgggtttcctttgaatatacactnttagccggagtgaatgattcggtcgagcatgcgattgaactggcagaattgcttcatgaatggggtcgtggtcatcatgtgaacttaataccatataatccaat

SEQ ID NO: 1628 - DNA, 694 bp, Artificial
  Synthetic
tttttgagtttcctcaccacaaaatgattccaagaaagcattggtttttatttattacattatagccatatttattccaaaattaatgttggctcaaaactgtgggtgtgcagaaggtttatgctgcagcagatggggttactgtggcactggaaatgaatattgtggtcaaggctgcaaaggagggccttgttttatttcagcaaattatggaatttcatcagtttctgaaattgtttctgaaccatttttcaatggaattgctaatgaagcggctccaaactgtgaaggcaaaggattttacacaagatctgcttttcttgaagctctcaggtcttatcctacatttggaactgatgcttcttctgatgataataagcgtgaaattgctgctttctttgctcatgttacccatgagactggacaaatgtgctacagaaatgagataaatggtgcatctagggactattgtgacgagacaaatgcagagtacccatgtgttctcggcaagaaatattacggtcgaggaccgatacaattgtcatggaatttcaactatggaccggcggggaaagacaatggattcgacggcctgaacgaccctgatatcgttgctagagacagtctgatatcattcaaaactgccctgtggtactggatgaacaattgccatgctctcataacttctggacaa

SEQ ID NO: 1629 - DNA, 650 bp, Artificial
  Synthetic
cacccacgcctccgcaaagcggtgctttcacaaaaatctccttagtccttcttctctgcctcttaggtttcttttctgaaactgtcaagtctcaaaactgcggttgcgctccaaacctctgttgcagtcagttcggttactgtggtaccgaccatgcatactgcggtgttggatgccgatcaggtccttgtagaggtagtggaacccctaccggagggtcggtcggtagcattgtgacacaaggtttctttaacaatattatcaaccaagctggtaatggttgcgcggggaaaagattctacacccgtgactctttcgttaacgccgctaatactttccccaactttgccaattctgttaccagacgtgaaattgctaccatgtttgctcatttcactcacgagaccggacatttctgctacatagaagagattaacggagaaacacgtaactactgccatagcagcaacacacaatacccatgtgcaccgggaaaaggctacttcggtcgtggtccgatccaactatcatggaactacaactacggagcgtgtggtcaaagtctcggtcttgaccttctacgccagccctaacttgtgggtagcaacccaactgtagctttcaggacgggtttgtggttttggatgaat

SEQ ID NO: 1630 - DNA, 334 bp, Artificial
  Synthetic
cccacgcgtccgccatattcctcaacaacatcaaaatgttgactcccaccatttctaaatccatctctttagtaaccattctattagttctacaagctttctctaacacaacaaaggctcaaaattgcggttgttcgtcagagctatgttgtagtcagtttggcttttgcggtaacacttcagactattgtggtgtaggttgccaacaaggaccttgttttgctcctccccctgcaaatggtgtctctgtggctgagattgtaacgcaagaattcttcaatggaatcatcagtcaagccgcgtctagttgcgccggcaatagattttacagtcg

SEQ ID NO: 1631 - DNA, 764 bp, Artificial
  Synthetic
atcttcaactccgagttctcttcctcctgctcgcgatcttagctgccgctgccgaagactgcggacgacaaggcggcggaagaagttgtccgcctggaaactgctgcagcaggtggggatggtgcggtgacactcccgaccactgcggcgaaggctgccagagtcagtgcggtggagtaacaccgccgcctggtgacggtgtcggatctatcatcacgaactccatcttcgagagcctgctcaagcaccgcagagactcgggatgtgccggtggcttctacacgtacagtgcgttcctcacggctgccagatctttcccgcggtttggaaacgaaggctcgttggagcagaggaagcgagagctcgctgccttcctggcacagacatccaaggagaccacaggtggatggccgactgctcctgacgggccttatcgatggggctattgcttcgttgaggaacaaaataaggacatctactgcagcgcttcggcgacatggccatgtaatggcagcaaaagatactttggtcgtggtcccattcagcttacatggaactacaactatggcctggcaggatcacaagtcggcttcgacggcatcaacgatccggacatcgtttcgcgagacgcggtggtgtcgttcaagacagcgatctggttctggatgacgccacagaacccgaagccttcgtgtcacgacgtaattctggggaaatggaggccatccagtgccgacttagcagcgggaaggactgcgagctat

SEQ ID NO: 1632 - DNA, 619 bp, Artificial
  Synthetic
ggcccgcgagggggttctacacctacgcgtcttcgtcagggccgcgacgaggttcccccggttcgccgccacgggctgcgccgacgcccgcaagcgcgaggtcgccgccttcctcgcgcagatctcccacgagaccaccggcggctgggccaccgcgcccgacggcccctacgcctggggcctctgctacaaagaggagatcaacccgcagagcagctactgcgacgccaccgacaagcagtggccgtgctaccccggcaagtcctaccatggccgaggccccatccaaatctcatggaacttcaactacgggccggcgggccaggccctgggcttcgatggtctgcgcaacccggagatcgtggccaactgctcggacatagcgttccagacggcgctgtggttctggatgacgccgagggacaccaagccgtcgtgccaccaggtgatggtcggggagtaccggcccggcccggccgacgtggcggctaaccgcacggcgggcttcgggctggtcaccaacatcgtcaacggcgggctcgagtgcaaccgggcaggcgacgcccgggtgaacaaccgcatcggcttctaccggcgctactgccaggtgctcggcgtc

SEQ ID NO: 1633 - DNA, 527 bp, Artificial
  Synthetic
ccccccgaaccatcacctctttcacaccatatcctataatggggaactcaccgacgccgacaatgctggcgttcctggctcttgggctagcgctcctcctctccggcaccggccaggcgagcgcgcagaactggggctgccagtcgaacatgtgctggagcaaatgggggtactggggcacgggcaagggctactggggaaatgggtgccgctctggcccgggctacggcggcggcggcggtggaggaggaggaggcggaggtggtggaggcggaagcggaggcaacggcgtgtctggaaagagcgtggtcaccgaggcgttcttcaatgggatcaagaaccaggccccgaacggttgcgccggcaagaacttttacacacgacagtcgttgcttaacgctgcccactcctactcgggcttcgccagggaccggaccaacgatgactccaagcgtgagatcgctgccttctttgcccacgtcactcatgagaccggacatatgtgctacatcaacgagataaacggg

SEQ ID NO: 1634 - DNA, 542 bp, Artificial
  Synthetic
gccagagccagtgctccggcagctgcggcggcggcggcccgaccccgccctccggcggtggcggcagcggcgtcgcctccatcgtgtcgcgctcgctcttcgaccagatgcttctccaccgcaacgacgcggcgtgcccggccaagaacttgtacacctacgacgccttcgtcgccgccgccaacgccttcccgagcttcgccacaaccggcgacgccgccacccgcaagcgcgaggtcgccgcgttcctggcgcagacgtcgcacgagaccacgggcgggtgggcgacggcgcccgatggcccctactcgtggggctactgcttcaaggaggagaacaacggcaacgttgggtccgactactgtgtccagagctcgcagtggccgtgcgccgccggcaagaagtactacggccggggacccatccagatctcctacaactacaactacggcccggcggggcaggccatcggctccaacctgctgagcaacccggacctggtggcgtcggacgccaccgtctccttcaagacggcgttctgg

SEQ ID NO: 1635 - DNA, 345 bp, Artificial
  Synthetic
cccacgcgtccgcaaaacatggctttcacaaaaatctccttagtccttcttctctgcctcttaggtttcttttctgaaactgtcaagtctcaaaactgcggttgcgctccaaacctctgttgcagtcagttcggttactgtggtaccgacgatgcatactgcggtgttggatgccgatcaggtccttgtagaggtagtggaaccccgaccggagggtcggtcggtagcattgtgacacaaggtttctttaacaatattatcaaccaagctggtaatggttgcgcggggaaaagattctacacccgtgactctttcgttaacgccgctaatactttccccaacttt

SEQ ID NO: 1636 - DNA, 683 bp, Artificial
  Synthetic
aaaacacagaacaagaattagaaagaagggagagaaagcaaaaatggcgctaagaatgtgggcttcttctacagcaaacgctctcaagctttcttcttctgtttccaagtctcatctctctcctttctccttctctagatgcttctccacagttttggagggtttgaagtatgcaaattcacatgagtgggttaaacatgaaggctctgttgccaccattggcatcactgcccatgctcaggaccatttaggtgaagtggtgtttgttgaactgccagaggacaatacttcagtgagcaaagagaaaagctttggagcagtggagagtgtgaaggcaacaagtgagatcttatcaccaatctcaggtgaaatcattgaggttaacaagaagctcacagaatcacctggcttgatcaactcaagcccctatgaagatggttggatgatcaaagtgaaaccaagtagccccgcggagttggaatctttgatgggtccaaaggaatacaccaagttctgcgaggaggaagatgctgctcactaggagggtttctctctgtcttttatgttcgaagttctatcaattctcatgcttgttttctaaatttgcatacactctatgaccaacttcacaaaataagagttcaagaagatgaaacagagacctaacaaacacattaagattt

SEQ ID NO: 1637 - DNA, 743 bp, Artificial
  Synthetic
gaaatgttaaaagtgacacctacaaagcacacctcaccaacttttgctgaatgagtttgtcgacacatcgatccaccagccaccacctttctcttccctacttttattattgcttccactttctattcaatacaccatttattttccactcgaaaagctatttccctaatacattgcacgtttgtcacaactctatattgaacttaaaaaaatggcaacaaagttatgggcttcaagggctgcttcatatctcgggatctcaacatttcacagggcttttgctactgtggccaaggatttaaagtatgcagagtctcatgaatgggttaaagttgatggtagttctgcaacaattggcatcactgatcatgctcaggatcatttaggtgatgttgtctatgttgaattgcctgaagttggggcttctgtaaatcaatttgacagttttggtgctgttgaaagtgtcaaggccaccagcgatatcaattctcctgtttcagggaaggtggtggaagttaatgagaagctcgactcctctcctgctctgatcaatgggagcccatatcaagaaggatggattataaaggtggagatgaacaaccccgacgagctcaaatcgttgatggaccctgacaagtattccagtttttgtgatgaagaagacgcgaaacactgattgaaacctcacaaagttgagcaagaacgcactttcctgcaggatttttcgtagtgcataaataggc

SEQ ID NO: 1638 - DNA, 675 bp, Artificial
  Synthetic
aagcttttgtggccgcaaggctgcgctccagtgcttgtggaaggaacattctctgccctaataatctgtcttgctgcttactacgatggctctacgcaccatggcgacgcaagctgcgacgctgctgagaattcggtgccagccgaactacctcgcgcaggcgctggcaattcgtggatttgcaactgaagccgcagctaccgttccaattccccaagatttgaagttcctcgagtcgcatgaatgggtgaaagtggaggatggaactggcaccgtaggaatcagtgaccatgctcagcatgagcttggagacgttgtgtttgcggacttgcccgaggtggggtcgtcggtgagcaaaggcaagaactttggcgtggtggagagcgtcaaggcttgcagcgacatctacagccccgtctctggcgaagtcgtcgaagtgaacgaagaggtcaaggcaacgccagctctggtgaacaagagtgcattcggcgatggatggctcatcaaagtaaagctgtccagcgtgtcggacctcgacggcctaatggattcagcagcatacgaagagcacgtcaagagtgaggctcactagccgagcacaaagcgcaaagcacaaatcacagtatgtttcgaaaagctctactagcaagaaggataattttctttccaaagtcc

SEQ ID NO: 1639 - DNA, 613 bp, Artificial
  Synthetic
agctaactaggagaaggaaaaaagaagaacgcagatactttggtaacaagcaagaaattggcacagaaatggctctgaggctgtgggctagctcagctgccaatgccctcaagatctcatgcagtggagccaccagggctgcacctgcctactcaatctccagatacttctccactgttcttgatgggttgaagtacagctcctctcatgagtgggtcaagaatgatggctctgtggccacaattggaattacagaccatgctcagggccatctgggagaggtggtgttcgtggagctgccggaggcgggggcgaaggtgagccagggaggtgcattcggcaacgtggagagtgtgaaggccaccagcgacatcaactcccccatctccggtgaggtcgtcgaggttaacgacaagctctctgagacacccggcctgattaactcaagcccgtacgaggacgggtggatgatcaaggtgaagccgagcagcccgtcggagctggacgccctgctggacccggccaagtacaccaagcactgcgaggaggaagacgctcactaggctcttcctctctgtgttttttctctcccattttgtcactccgacctaat

SEQ ID NO: 1640 - DNA, 692 bp, Artificial
  Synthetic
gccattacggccggggacattactagagagaaaaatggctttgagaatgtgggcttcttcaacagccaatgcattgagaatttccactgcctcaagagctaatctttcccctgcttattcactctctagatgcttttccactgttcttgatgggttgaagtatgcatcttcacatgaatgggtgaagcatgagggttcagtggcaacagttggaatcactgaccatgctcaggatcatcttggagaagtagtattcgtagatctaccagaaactggtgctgctgtttcacaaggaagcagttttggtgctgttgaaagtgtgaaagctaccagtgacattaactgtccaatctcgggcgagatcgttgaggtcaatacaaagctcactgaaacacctggtttggttaattcgagtccatatgaagacgggtggatgattaaggtgaagccgagcagtccatccgagctagaatctttgatggggtccaaagagtacacaaaattctgtgaagaagaggatagtcattaaaacttgaaggtttttctttattcaacgtggactaactttgcctggttaaggctgatactgtgatgaaacttcctgtcacttgttaaaattctacaaaaatcaaaataacatccactttcctggtgttttctatgccttatgcagagttgtgatgtagtttttg

SEQ ID NO: 1641 - DNA, 755 bp, Artificial
  Synthetic
cccgatcccctcatctcactgcagctttccgctatactaccaccaccactgagctgccactactcatccagctaactaggagaaggaaaaaagaagaacgcagatactttggtaacaagcaagaaattggcacagaaatggctctgaggctgtgggctagctcagctgccaatgccctcaagatctcatgcagtggagccaccagggctgcacctgcctactcaatctccagatacttctccactgttcttgatgggttgaagtacagctcctctcatgagtgggtcaagaatgatggctctgtggccacaattggaattacagaccatgctcagggccatctgggagaggtggtgttcgtggagctgccggaggcgggggcgaaggtgagccagggaggtgcattcggcaacgtggagagtgtgaaggccaccagcgacatcaactcccccatctccggtgaggtcgtcgaggttaacgacaagctctctgagacacccggcctgattaactcaagcccgtacgaggacgggtggatgatcaaggtgaagccgagcagcccgtcggagctggacgccctgctggacccggccaagtacaccaagcactgcgaggaggaagacgctcactaggctcttcctctctgtttttttctctcccattttgtcactccgacctaatttctccctgttgcaacaactgctctgtatccgtatacgattaataactgaatcttcaggctttgccatgtgttc

SEQ ID NO: 1642 - DNA, 629 bp, Artificial
  Synthetic
gaattcatgagagtgtgggcttcttcaattgcgggggcacttaaattctcttcatcttctaccttgaagcagacttcactctatccatctgcttttgccgcctccaaatgcttctccaccgttttggatggattgaaatatgcaccatcacatgaatgggtgaaacatgaaggagatgtacctaccattggtattacagaccatgctcaggatcatttgggagaggtggtgtttgtggagctaccataagctggtggtgcagtgacaaaagcaagtggatttggagctgtagagagtgtcaaggcaacaagtgacatcaactcgcctatttctggagagattgttgaggtcaacaccaagctcaccgacacccctggcttgattaactcaagtccttatgaggatggatggatgatcaaagtgaaaccatcaagtccagctgaacttgaatctttaatggattcaaagggttacaccaagttctgtgaggaagaagatgccagccattaatttagtttgatggatatgtttctttctttgccactttgtttcgaaatttcgatttgggttagctaactgaaatttctccatctgcagttgttatcaataatgatgtcaatattactgaa

SEQ ID NO: 1643 - DNA, 671 bp, Artificial
  Synthetic
atggtatcaacgcacagtggccgggtacggccgggggaaaaatggctttgagaatgtgggcttcttcaacagccaatgcattgagagtttccactgcctcaagagctaatctttcccctgcttattcactctctagatgcttttccactgttcttgatgggttgaagtatgcatcttcacatgaatgggtgaagcatgagggctcagtggcaacagttggaatcactgaccatgctcagggtcatcttggagaagtggtgtttgtggatctaccagaaactggtgctgctgtttcacaaggaagcagttttggtgctgttgaaagtgtgaaagctaccagtgacattaactgtccaatctcgggcgagatcgttgaggtcaatacaaagctcactgaaacacctggtttggttaattcgagtccatatgaagacgggtggatgattaaggtgaagccgagcagtccatccgagctagaatctttgatggggtccaaagagtacacaaaattctgtgaagaagaggatagtcattaaaacttgaaggtttttctttattcaacgtggactaactttgcctggttaaggctgatactgtgatgaaacttcctgtcacttgttaaaattctacaaaaatcaaaacaacatccacttttctggtgttaaaaaaaa

SEQ ID NO: 1644 - DNA, 707 bp, Artificial
  Synthetic
gtcaggttctaggaagagagagagagagagagcctagccagccagccagccagaaaacggtagttatggcccttcgttcatttgctgcgcaggctgtctctcgcctccgttgcagttgccgtagtagcggcaacttcgcacctgccgtcgcttcttccttccttcgccatttcagctctgcctatccatcggacttgaagtacgccaaatcgcacgaatgggtgcgagccgaggattccaaggcgaccatgggcattaccgactttgccttggagcaactgggagatgtggtttatgtggaattgcctagcgttggacaggaggtagctcaaggcgagtctgtttgcacggtggagagtgtcaaagcagccagtcaggtctatgcccccatcagcgggaaagtagttgaggtcaacaccgagatcacaacgaaacctgaaacgatgaaggatgatccctatggaacaagctggttggtgaaatttgatatcagcaaacctgatgagctcaaggcactcttggacgcagatgcttacaagacccaagttgagagtgaagaacatcactgattttagtaatcctgaaccttattcttgttgtaagcagttgaatgccagttatctttattgaaatcaaatatgatccaaatcagatcaatatgtggagggactatgggctagtgagttgttgtcttgtctcgttcttga

SEQ ID NO: 1645 - DNA, 743 bp, Artificial
  Synthetic
cttcactctgtcttcacactctctgcttttgccgtaggacagaatcgtcgagtttagtgacgaagactgtaatcaatggcatcagctacagcttctcacactttgtgcggcatccccgccacctcatcctctactaccaacaagtctattgccccttcatctgctcgcttcctctctaaaactcctctccgccgcctcggcttcgctggcgccgccgctgattctctcttcaccaaccacgtggcaaccaagctccgatccctcaagagctcctccaagcctgttaggggcgttgcttctatggccaagaaaagcgtcggagacctcaccgctgccgagttgaagggcaagaaagtcttcgtcagggccgatttgaatgtcccacttgatgatagccagaacattactgatgacactagaattagagctgccgtccctactatcaagcacttgatggccaatggtgctaaagttattctctccagtcacttgggacggccaaaaggagtcactcctaaatacagcttggcacccctagtccctaggctatccgaactgcttggaatccaggttgtgaaggctgaggactgcattggtccggaagtcgagaagttggttgcttcacttcccgagggtggtgttcttcttctcgagaacgtgagattctacaaggaggaagagaagaacgaacctgagtttgcaaagaaacttgcatcattggcagatctttacgtaaacgatgc

SEQ ID NO: 1646 - DNA, 683 bp, Artificial
  Synthetic
gttctatcgatcgatcgatccatcagccatggccgccgcaacagccgccgcatcgtcgcagctcctctcgccggcggcgtcgctgggctcggcggcgtcgccgtcgtcgtcgtcgtcgccttccggcaatcgcgccgggttcaggtcattggggaggcaatgcttcgcgggactcgtcgcggggcgccgggaggtgcggcggctgggggatttcgagcggcagcagccggatttcgcggcggcagtggcggcggcggtgaggtcgtcggggggcaatgggcgcggcagccgcggcgtggtgtgcatggccaagaagagtgtgggggatctcaaggaggcggacttgaaaggcaagcgtgtctttgtcagggctgatctcaacgttccactggatgccgatctaaacatcaccgacgatacgaggattcgtgctgccgtgccgacgatccagtatctcattggcaatggggctaaggtcatcctcagcagccatctggggcgtcccaaaggagtgaccgagaagtatcgacttacacctcttgttggaaggctctcagagctcttgggaaccaaggttgagaaggctgacgattccattggtcccgaagtcgagaagaaagttgctgctttgcccgatggtggactgctacttctcgagaatctgaggttttatcctgacgagg

SEQ ID NO: 1647 - DNA, 460 bp, Artificial
  Synthetic
gcgggagcaagcaaaatttaagccctgatcggattgtggaggtttatgctatttgagaagccaaaaagctactacgcccgtttttccagaagataatgtccgtgactttgcatacgaatctgggagacatcaagtgtgaaatcttctgtgacgaagtccccaagacggctgagaactttctggccttatgtgccaataattattacgatggaaacatcttccaccggaacatcaaaggattcatgattcaaggtggcgatccaacagggacgggaagaggaggcactagcatatggggacgcaaattcagtgatgaaatccgggaatctctcaagcataatgcgacgggtattctttccatggcaaatagtggtccaaatacccaatggaagtcagttcttcatttcatatgccaagcagcctcatctaaatggcatttacactgtgtctggacgggtta

SEQ ID NO: 1648 - DNA, 583 bp, Artificial
  Synthetic
cccaaccccccccgagtcagctctaatagggccaaagactctagcagcaaaacatgtcagtgacgcttcatacaaacctaggcgacatcaagtgcgaaatcttctgtgacgaagtccctagaactgctgagaacttcttggcattatgcgcaagtggttattatgatgggacaatatttcacagaaacataaagggtttcatgatccaagggggtgacccaacaggtacaggaaaaggcgggacaagtattaggggaaaaaaattcaatgacgagataagggagtctctcaagcacaatgcaagaggaatattgtcaatggccaacagtggccctaataccaacgggagccagtttttcatgacatatgccaagcaaccacatcttaatggattgtacaccattttcggaaaagtgatacatggatttgaggttcttgatatcatggaaaagactccaacaggaccaggtgataggccccttgccgaaatcagactcaaccgggtgacaatacatgctaatccacttgctggttgacgttatttcgaactcatgctacggcagtatgtttaatctcattattg

SEQ ID NO: 1649 - DNA, 175 bp, Artificial
  Synthetic
agttcatttttgttgcagctgaaggcttgtgtgttgttgcagtcggtgacattgcacaccaatttgggagacatcaagtgcgagatcttctgcgacgaggtaccaaaggcagcagagaactttctggcactgtgcgctagtggctactacgatggtaccgtcttccaccgcaaca

SEQ ID NO: 1650 - DNA, 668 bp, Artificial
  Synthetic
tagggctagtgtcgccatggggagaatgaagccggcagcactgctgcagcaaagcaagcgcaagaagggaccgtcgcggctcagccttcccaccatcgtctcctgcaacctcatcgtcgtcctcctcttcttctccatcctagcgctccacaggcacaatcgcaatagtagtagcggcaattggaatgcccaggtcgctggacgaaaggagaaaatgggacttcttcccaagtatgcgtggatgaacacaaccaaaggggtaattgttttggagctctttggcgatgaagttccgaaggccgtggagaacttcgcggtgcatgggcagaaaggatactacgacggcgtcaagttccacagagtgatcaaggactttatgatccaagctggtgatcccaccggcgacggacgaggaggcgactccatctggggtggatccttcaaagacgagttcagaccaaacttgaagcacgaagcatttacgttatccatggcgaattctggcccggattccaatcggtcccagttcttcatcacaactgtggagacaccacacctggatggcaagcacacggtgtttggacgcgttgtgcgtggtcaagaagttgtaaaggaaatagaaagccaggaaactaatgcggagaatcagcctttggtccctgttgtca

SEQ ID NO: 1651 - DNA, 703 bp, Artificial
  Synthetic
gggcgcgagcaacagccgtcacctgcttcaggtgggggaagcaaaagaaagaagagcctggaggagctgcgtttggaacgactgcagagggaggagagcgaacgggccaaggcccgcaagttactgccgtcaggtggcactcggaagcactacaactcgagctttggcaacaggagttagtgattttagggttgtgttttgtaatggaagaaggcgcaccgttagtcactctggagacgtccatgggctccttcactctagagctctaccataagcatgctcccaaaacgtgccgtaattttggcgagctggccaggcagggctactacaacgacgtcaagtttcaccgcgtcatcaagggttttatgattcagggtggtgatcccactggcacaggcaggggcggagagtccatctacgggcacaagttcgaggacgagctaacgcgggagctcaagcacacgggagcgggtgtcttatccatggccaactcggggcctaacaccaacggcagccagttcttcgtaacgttagcccccacaccgtggctcgacggcaagcacaccatattcgggagagtctgcaaagggatggaagttatcaagcggctgggaaacgtacagacggacaagagcgacaggccggtgcacgacgtcacgattctcaaggccaccgtggaagactgagtcaagagctcctcaga

SEQ ID NO: 1652 - DNA, 575 bp, Artificial
  Synthetic
atcggccgtctttggaggtttcactcctgcgctttccgctgctcacagccgcgcgcgcttcgtctcctccgccaccgctgaccccaaggaagtggacctccagtccaaaatcacaaacaaggtgtactttgacataagcatcggaaaccctgttgggaagaacgttgggagggtcgttattggcctatacggggatgatgttccccagaccgcagagaacttccgtgctctttgcactggagaaaaagggtttggttacaaggggtccagtttccaccgtgtcattaaggacttcatgattcagggaggagactttgacaagggcaacggtactggagggaaaagcatatatggccggaccttcaaagacgagaacttcaaattggttcatactggacctggagtggtcagcatggccaatgctgggccaaacaccaatggcagccagttcttcatctgcactgtcaagacaccttggttggatgggaggcacgtcgtgtttgggcaggttattgaaggcatggacatcgttaagatgatcgaatcgcaggagactgacagaggggaccgcccga

SEQ ID NO: 1653 - DNA, 672 bp, Artificial
  Synthetic
cggctccattcatgccgcagtgcaggtggccgaggtgcaatccaaagtgacacacaaagtttattttgatattagcattgggaatcctgttggaaagcttgctggacgaattgtaattggattatatggtgatgatgtgccacaaacagcagaaaatttccgtgcactctgcacaggtgagaagggctttggctacaaggattctgcatttcatcgtgttattaaagatttcatgattcaaggaggtgatttcgataaaggaaatggaaccggtggtaaaagcatatatggtcgtacctttaaggatgaaaacttcaagttgactcatactggacctggagttgttagcatggccaatgcaggccctaataccaatggaagccaattcttcatttgcactgtcaagaccccatggcttgatgagaggcatgttgtgttcggacaagttttagaaggcatggacattgtgaaattgattgagtcgcaggagaccgataggggtgaccgtccaaggaagagggttgtcatcagtgactgcggtgagctacctgtggcatgaggcgggaatacaaatataaagcactttattatgttaagactcgttgccagatataagaggattctcagtactgagttttcatccaaaacccagctttttcctgttcctttttt

SEQ ID NO: 1654 - DNA, 554 bp, Artificial
  Synthetic
gtgagttgatgatgggctctctgagctccctctctctcttcctcctccacttggccttagcttgccttgccttctccgtagctgagatcatcttcgaggaacgttttgaagatggatgggatagtcattgggtcaaatctggatggaagaagagtgaaggacttgctggaagctggcgacatacagctggcaaatggttttctgacccagatgataaaggtatacagacttaccctgatgcccgatttttcgctatctctgcacaactccctgagttcagcaataagaaccgaacccttgtgcttcaatactcggtaaagatcgagcagaagattgaatgtggcggagcttatgtaaaactcatgagtggttatgtgaaccagaaaaggtttagcaaggacaccccttacagtatcatgttcggaccggatctatgtggtactgatacaaaaaagcttcacacaattatctcctacaagggtcagaattatcccatcaagaaagagctacagtgtgagactgatcagctcacgcatttttacacgctaatcata

SEQ ID NO: 1655 - DNA, 584 bp, Artificial
  Synthetic
cccccggggaaagtcggtgggtcaagtcagaatggaagaaggatgagaacatggctggtgaatggaaccacacatctgggaagtggaatggagatcctgaggacaaaggtatccaaacctctgaggactacaggttctacgctatttcagcggagtacccagaattcagcaacaaggataaaaccctggtgctgcagttctctgtaaagcatgagcaaaagcttgactgtggtggtggatatgtcaagttgcttggtggtgatgttgaccagaagaaatttggtggggacacaccgtacagcattatgtttggaccagacatctgtgggtacagcaccaagaaggtccatactatctttactaagaatgacaagaaccatttgatcaagaaggatgtcccctgtgagactgatcagctgtcccatgtgtacactttgatcatccgtcctgatgctacatacaccatactcattgacaatgttgagaagcaatctggcagcatctacgagcactgggatattctgcctccgaagcaaatcaaggacccagaagctaagaagccagaggactgggatgacaaggag

SEQ ID NO: 1656 - DNA, 1028 bp, Artificial
  Synthetic
cccccggatacgggagattggatcggaagcttctagaagtttccgtgggcgatggcgatccgcgcgaggtcctcctcctacgccgccgcggcggtcgcgctggcgctcgcgctggcgtccgtcgccgctgtcgccggcgaggtcttcttccaggagaagttcgaagatggatgggaaagtcggtgggtcaagtcagaatggaagaaggatgagaacatggctggtgaatggaaccacacatctgggaagtggaatggatatcctgaggacaaaggtatccaaacctctgaggactacaggttctacgctatttcagcggagtacccagaattcagcaacaaggataaaaccctggtgctgcagttctctgtaaagcatgagcaaaagcttgactgtggtggtggatatgtcaagttgcttggtggtgatgttgaccagaagaaatttggtggggacacaccgtacagcattatgtttggaccagacatctgtgggtacagcaccaagaaggtccatactatctttactaagaatgacaagaaccatttgatcaagaaggatgtcccctgcgagactgatcagctgtcccatgtgtacactttgatcatccatcctgatgctacatacaccatacttattgacaatgttgagaagcaatctggcagcatctacgagcactgggatattctgcctccgaagcaaatcaaggacccagaagctaagaagccagaggactgggatgacaaggagtacattcctgaccctgaggacaagaagcctgagggatacgatgatattcccaaggaaatccctgaccctgatgctaagaagcctgaggactgggatgatgaggaacatggtgagtggactgcaccaaccattcctaaccctgagtacaagggaccatggaagcaaaagaaaatcaagaaccctaactaccaaggcaaatggaaggcaccgatgatcgacaacccagacttcaaggatgatccatacatctatgcttttgacagcctgaagtacattgg

SEQ ID NO: 1657 - DNA, 563 bp, Artificial
  Synthetic
gttgccttctcttggtactcttccccttggcctctttcgcccacgttttcttcgaagaacgcttcaatgatggatgggagaacggatgggtgaaatcggattggaaaaaggatgaaggtgctgcaggagactgggtacacacggcagggaaatggagtggtgactccgaagacaaagggattcaaaccaatccagacttacgattttttggcatatcaactgagtttcctgaatttaacaacaagggcaaggatttggttgtccagttttctgtaaagcatgaacaggatcttgattgtggtggaggttatatcaagcttttaagtggtgatgtggatcagaaaaagtttaatggtgataccccgtacagcatcatgtttgggcctgacttctgtggctatagcacaaagaaagtccatgttattttgaactacaatgacaagaatcaccccattgagaaggaaatttcttgtgaaaaggatcaactgacacatgtctacactcttgtgataagacctaacaacacctacagtgttctaattgataatgaagagaaacaaaac

SEQ ID NO: 1658 - DNA, 344 bp, Artificial
  Synthetic
ccgatctgagttttttttagcaatggcgagaatgattcctagcctcgtctctctaattcttatcggtcttgttgcgatcgcctccgccgcagttattttcgaggagcgctttgatgatggctgggagaacagatgggttaaatctgagtggaagaaggatgataacactgctggggagtggaagcacactgcgggaaattggtctggtgacgctaacgataaaggtatccagaccagtgaagactacagattctacgccatttcagctgagttccctgaattcagtaacaaggacaagaccttagtcttccaattctcagtcaagcacgagcaaaagcttgact

SEQ ID NO: 1659 - DNA, 284 bp, Artificial
  Synthetic
cgggacatgggctggtgatcctgatgacaaaggtatccagacaacaaacgatgccaaacattttgctgtctctgcaaaggtaccggaatttagcaataaaaacagaacactggttgtccagtattctataaagtttgagcaagatattgaatgtggagggggttacataaagcttctctctggatatgtcaatcagaagaaatttggtggagacactccatacagttttatgtttgggccagatatctgtggtacacagacgaagaaacttcatgttatgcttt

SEQ ID NO: 1660 - DNA, 666 bp, Artificial
  Synthetic
gtctcctcgacggttatcgatcgatctctcgcggttgatcgatctctcacatcgatcgcctcgatctgatgcgttgctggctgcattccaggttaatccggcggatcgatgaggatttccgcgatcgccgcggcagttctcgcggcgattctcgcgctggctctttctggagctgcggagatcttcttcgaggagcgattcgacgatggttgggaacatagctgggtccagtccgattggaagcgatccgacggtctagcggggagctggcgacacacagcagggaaatggcatggtgatccagatgataaaggcatccagacttatcccgatgctcgatacttcgccatctccgcgcagttccccgagctcaacaccaaaggaaagacgctcgtaattcagtactctgtgaagcacgaacaaaagatcgagtgtggtggcggctatatcaagctactcagtggttacgtgaatcagaaacggttcagtggggatacgccttacagtatcatgtttggtccggacatttgtggcactcagaccaagaaggtccacgcgattttgcagtataagagccagaactatccaatacggaaggaagttacttgcgagacggaccagctcactcacgtttacacgttggtaattcgtcccgacgcaacttac

SEQ ID NO: 1661 - DNA, 609 bp, Artificial
  Synthetic
taaaactagtcttctcagctgaatcatttctactagttttgttacttttctcacttctcagctcttcattctctgagatcttttttgcagaacagttcgatgatgattggcggagcagatgggtgaagtctgactggaaaaggagtgaagggaaagcaggttcatttaagcatacagctggaaaatgggctggtgatcctgatgataaaggtattcagacatcaagcgatgccaaacatttcgccatttctgctaaggtaccagaatttagcaacaagaacagaactttggttgtacaatattctataaagtttgagcaagacattgagtgtggtggaggttacataaagcttctctctggatatgtcaaccagaagaaatttgggggagacaccccttacagtatgatgtttggaccggatatctgtggtacacagacaaagaaacttcatgttatgctttcctatcaaggccagaattatcccatcaaaaaggatctacaatgtgaaacagacaaattaacccatttctacacattcattcttagacctgatgcatcatacagcatctggattgatggtcgagaaagggattctggaagcatgtata

SEQ ID NO: 1662 - DNA, 602 bp, Artificial
  Synthetic
caggcacttcaccaaccctctggctcccttccgccgccctccgccgccgcatgcaagccaacctcgccgctgccatggccgcccagaccctcttgttctccgccaccgcccctcccgcctcccttttccagtccccttcctctgcccgccctttccactcgctccgcctcgccgccggccccgggggcgccgccgctgccagggcgctcgtcgtcgccgacgccaccaagaaggccgtcgccgtgctcaagggcacctcccaggttgagggagtcgtcaccctcacccaggatgaccaaggtcctacaacagtgaatgtccgtgtgacgggacttactcctggacttcacggcttccacctccacgagtttggcgatactacgaatgggtgcatatcaacaggaccacattttaacccaaacaatttgacgcacggtgcaccagaagatgaagtccgtcatgcgggtgacctgggaaacattgttgccaatgctgaaggtgtagctgaggcaaccattgttgataagcagattcctctgagtggcccaaattctgttgttgggagagcattcgttgttcatgagcttgaagatgatttgggg

SEQ ID NO: 1663 - DNA, 682 bp, Artificial
  Synthetic
caatggttgcctcagctacaccttcagcattggcaacaatgtttcccaggtcacccgcatgacggacttcatcttctggtgcaccgtgcgtcaaattgtttgggttaaaatgtggtcctggcgatactacgaatgggtgcatatcaacaggaccacattttaacccaaacaatttgacgcacggtgcaccagaagatgaagtccgtcatgcgggtgacctgggaaacattgttgccaatgctgaaggtgtagctgaggcaaccattgttgataagcagattcctctgagtggcccaaattctgttgttgggagagcattcgttgttcatgagcttgaagatgatttggggaagggtggccatgagcttagtctcagtactggaaatgctggtgggcgacttgcatgcggtgttgttgggctgaccccgttgtaggtcgctgcaagttgcagctgaagtgtcagtatcgcatccatgtcaccctttttgtcatcttcgagcctgaggcagtcgttcttgtatcacatggatttcgcaacatggatgcttaatagtatctgttgatcgttcgtctcacagtaataaaatttagttgagcaaataagtgtcgtcacatcccctgttctccaccctgtcaaactataaattgtgaaacatgagctgttctgggtatacaacgcata

SEQ ID NO: 1664 - DNA, 883 bp, Artificial
  Synthetic
ctcatctcaatcttagccacctgtgtggaatccatggccgcccacacaatcttcactaccaccaccagcactaccaattctttgttattcccagtcgctgcccctaacaccaacccctccccttcacttcactcttctttccacggtgtttccctcaatctcaagtcaaagactcctcaatctttaacactttctgctgccactgctcctaaacgtctcactgtttttgctgctactaagaaagctgttgctgtccttaagggcaattccaatgttgagggcgttgtcactctctcccaagatgatgatggtccaaccactgtgaaagttcgcataactggacttacacctggacttcatggattccatttgcacgagttcggtgacactacaaacgggtgtatgtctacaggaccccatttcaatcctgatggcaagacacatggagctcctgaagatgaaatccgtcatgcgggtgacctgggaaacatagtggccaatgccgatggtgtggctgaagcaacaattatagataatcagataccattgtatggtccaaactcagttgttggaagagcgcttgtggttcacgagcttgaggatgaccttgggaagggtaggcatgaactcagccttaccactgggaatgctggtggacgattggcatgtggcatacttggtttgactccaatatgaagtaatcaagattgatccaggaatagaatatcaatagcaagctgactgcggcttcattgattcaagttgaactattatgctgaagtttcgaaacttcagctagtacgactataggacaaaaacttcagcttatttagttctgaagttttacaaatgaactaaataacttcaacttcttctgctaatg

SEQ ID NO: 1665 - DNA, 408 bp, Artificial
  Synthetic
agccatggctgccaccaacacaatcctcgcattctcatctccttctcgtcttctcattcctccttcctccaatccttcaactctccgttcctctttccgcggcgtctctctcaacaacaacaatctccaccgtctccaatctgtttccttcgccgttaaagctccgtcgaaagcgttgacagttgtttccgcggcgaagaaggctgttgcagtgcttaaaggtacttctgatgtcgaaggagttgttactttgacccaagatgactcaggtcctacaactgtgaatgttcgtatcactggtctcactccagggcctcatggatttcatctccatgagtttggtgatacaactaatggatgtatctcaacaggaccacatttcaaccctaacaacatgacacacggagc

SEQ ID NO: 1666 - DNA, 556 bp, Artificial
  Synthetic
acaccatctggaatcttgtttaacactagtattgtagaatcagcaatggcagcatacaccagcaagatctttgccctgtttgccttaattgctctttctgcaagtgccactactgcaatcaccactatgcagtatttcccaccaacattagccatgggcaccatggatccgtgtaggcagtacatgatgcaaacgttgggcatgggtagctccacagccatgttcatgtcgcagccaatggcgctcctgcagcagcaatgttgcatgcagctacaaggcatgatgcctcagtgccactgtggcaccagttgccagatgatgcagagcatgcaacaagttatttgtgctggactcgggcagcagcagatgatgaagatggcgatgcagatgccatacatgtgcaacatggcccctgtcaacttccaactctcttcctgtggttgttgttgatcaaacgttggttacatgtactctagtaataaggtgttgcatactatcgtgtgcaaacactagaaataagaaccattgaataaaatatcaatcattttcagacttg

SEQ ID NO: 1667 - DNA, 603 bp, Artificial
  Synthetic
ataacattatattgcagcaatgggatcctcctcccttctactcgcctgtgttgtggtggcggctatggtgtccgccgtctcctgcgggccacccaaggtgccaccgggccccaacatcacgacaagctacggcgacaagtggctggaagccaaggccacctggtatggtgcgcccaagggtgctggccccaaggacaacggcggcgcctgcgggtacaaggatgtcgacaaggctcccttcctcggcatgaactcctgcggcaacgaccccatcttcaaggacggcaagggctgcggctcatgcttcgagatcaagtgctccaagccggaggcctgctccgacaagcccgcccttatccacgtcaccgacatgaacgacgagcccatcgctgcctaccactttgacctctccggccttgccttcggcgccatggctaaggatggcaaggacgaagagctccgtaaggccggcatcatcgacacgcagttccgccgcgtcaagtgcaagtatcctgccgacaccaagatcaccttccacatcgagaaggcctccaaccccaactaccttgcgctgctagtcaagtacgtcgctggtgatggtga

SEQ ID NO: 1668 - DNA, 609 bp, Artificial
  Synthetic
aaaaaaaaaaggaaaaaaaaacaaaacacaccaagccaaataaaagcgacaatgggatcgctcaccaccaacatcgtcctcgccgtcgccgtggtggcagcgctggtcggcggcgggtcgtgcggcccgcccaaggtgccacccggcccgaacatcacgaccaactacaacgccccgtggctccccgccagggccacctggtacggccagtcctacggctccggccccgctgacaatggtggcgcgtgcgggatcaagaacgtcaacctgcctccctacaacggcatgatctcctgcggcaacgtcccaatcttcaaggacggcaggggatgcggctcatgctacgaggtgaagtgtgagcagccggcggcgtgctcgaagcagccggtgacggtgttcatcacggacatgaactacgagcccatctcggcgtaccacttcgacttctccggcaaggcgttcggcgccatggcttgcccggggaaggagaccgagctccgcaaggccggcatcatcgacatgcagttcaggagggtgcgctgcaagtaccccggcggccagaaggtcaccttccacgtcgagaagggctccaaccccaactacctcgcc

SEQ ID NO: 1669 - DNA, 619 bp, Artificial
  Synthetic
cagaatcctacctgactagtactaccactactagctagtagcgagctactctctctggtcatcaagctttgagtggttggagtggtggcagctatggctttttccatctccaagaaggctgcagttgctgcactcttctccttccttgttgtcacctgcgtcgccggcgccaggccggggaacttcagcgcctccgacttcaccgccgatcccaactgggaagtcgccagggccacctggtacggcgctcccaccggcgccggccctgacgacgatggcggtgcttgcgggttcaagaacaccaaccagtacccgttctcgtcgatgacctcctgcggcaacgagcctatcttcaaggacgggaagggctgtggctcatgctaccagataagatgcgtcaaccaccctgcctgctccggcaacccggagacggtgatcatcaccgacatgaactactaccccgtttccaagtaccacttcgacctgagcggcacggcgttcggcgccatggccaagccggggcagaacgaccagctccgccacgccggcatcatcgacatccagttcaagagggtgccgtgcaacttccctgggctgaaggtgacgttccacgtggagg

SEQ ID NO: 1670 - DNA, 638 bp, Artificial
  Synthetic
tccaccagcaataacattatattgcagcaatggcatcctcctcccttctactcgcctgtgttgtggtggcggctatggtgtccgccgtctcctgcgggccacccaaggtgccaccgggccccaacatcacgacaagctacggcgacaagtggctggaagccaaggccacctggtatggtgcgcccaagggtgctggccccaaggacaacggcggcgcctgcgggtacaaggatgtcgacaaggctcccttcctcggcatgaactcctgcggcaacgaccccatcttcaaggacggcaagggctgcggctcatgcttcgagatcaagtgctccaagccggaggcctgctccgacaagcccgcccttatccacgtcaccgacatgaacgacgagcccatcgctgcctaccactttgacctctccggccttgccttcggcgccatggctaaggatggcaaggacgaagagctccgtaaggccggcatcatcgacacgcagttccgccgcgtcaagtgcaagtatcctgccgacaccaagatcaccttccacatcgagaaggcctccaaccccaactaccttgcgctgctagtcaagtacgtcgctggtgatggtgacgtcgtggaggtggaaatcaaggag

SEQ ID NO: 1671 - DNA, 703 bp, Artificial
  Synthetic
attcacaaataactaacacccatcagcaacaatggcatcctcttgtctccttctggcctgtgtcgtggcagcggccatggtgtctgcagtgtcatgtgggccgcccaaggtgccgcctggccccaacatcactgcggcctacggcaaacagtggctggaagctaggggtacctggtacggcaagccaaagggtgccggccccgacgacaacggcggcgcttgtgggtacaaggacattgacaaggctcccttcctcggcatgaactcatgtggcaatgaccctatcttcaaggatggcaagggctgcggctcctgctttgaggtcaagtgttccaagccagaggcctgctccgacaagcccgtcatcatccacatcaccgacatgaacactgagcctatcgccgcctaccacttcgacctctccggccatgcttttggtgccatggctaaggaaggcaaggatgaggaactccgcaaggcgggaattatcgatatgcagtttcgtcgcgtccgctgcaagtaccctggtgagactaaggtcaccttccacgttgagaagggctccaaccccaactactttgcagtgcttgtcaagtacgtcggtggtgacggtgatgtcgtgaaggtggaacttaaggagaaaggctctgaggagtggaagccactcaacgagtcatggggtgctatctggaggatagacact

SEQ ID NO: 1672 - DNA, 659 bp, Artificial
  Synthetic
ccccccccgggggcagtagcaagcaagcagggctaatatacataaattgatccagggatcgatcgaaattaatggcgggcaggagcaggaggaggtcgttttggtccgtgggcgttgcggctgctctgctttgtctgctggccgcccatggctgcagcgccaagcatcacaagcccaagcctactcccggtggcatcagtggcaatgcttcttcttcctcctccaattccagcacccccagtattcctcctcctgttgcccctactcctactgctcctactcctcctattcccagccccggaactggaagcagcaacggcagcagtggcggtggcggcggcgggtggctgaacgcccgtgcgacctggtacggcgctcccaacggcgctgggccggacgacaacggcggcgcgtgtgggttcaagaatgtgaacctgccgcccttctcggccatgacttcctgcggaaatgagcctctcttcaaggacggcaagggatgcggctcctgctaccagatccgatgcgtggggcacccagcctgctcggggctcccggagacggtgatcatcacggacatgaactactacccagtgtcgctgtaccacttcgacctcagcggcacggcgttcggcgccatggccaaggacaaccgcaacgac

SEQ ID NO: 1673 - DNA, 982 bp, Artificial
  Synthetic
cagctatggctttttccatctccaagaaggctgcagttgctgcactcttctccttccttgttgtcacctgcgtcgccggcgccaggccggggaacttcagcgcctccgacttcaccggcgatcccaactgggaagtcgccagggccacctggtacggcgctcccaccggcgccggccctgacgacgatggcggtgcttgcgggttcaagaacaccaaccagtacccgttctcgtcgatgacctcctgcggcaacgagcctatcttcaaggacgggaagggctgtggctcatgctaccagataagatgcgtcaaccaccctgcctgctccggcaacccggagacggtgatcatcaccgacatgaactactaccccgtttccaagtaccacttcgacctgagcggcacggcgttcggcgccatggccaagccggggcagaacgaccagctccgccacgccggcatcatcgacatccagttcaagagggtgccgtgcaacttccctgggctgaaggtgacgttccacgtggaggaggggtcgaacccggtgtacttcgcggtgctggttgagtacgaggacggcgacggcgacgtggtgcaggtggatctcatggaggccaactcccagtcgtggacgccgatgcgcgagtcgtggggctccatctggaggctcgactccaaccaccgcctcacggcgcccttctcgctccgcatcaccaacgagtccggcaagcagctcgtcgccagccaggtcatcccggccaactgggcccccatggccgtctaccgttctttcgtccagtacagcagctaagccaatgatcaagaacaagcataattcatgcctactatagcagcagcagaagcagcattagctactatacatacctctacgtacgacatttgagatcgatcgtttggccatttttatctgctcgggtattgattagctctccctcggtattgtatggatttgcatggatg

SEQ ID NO: 1674 - DNA, 673 bp, Artificial
  Synthetic
  misc_feature (3)..(3): The residue at this position can be any nucleotide.
cccacgcgtccgatctcacttcactctctttctcttctcttcacttcaccaccgccacctctctcatcggatccctgcagaggaggagagggcagtggcggcgaaaggcgacatgggctcgctgtcctctctcgccgccgcggcggtgtttctctccctcctcgccgtcggccactgcgccgccgccgacttcaacgccaccgacgccgacgccgacttcgccggcaacggcgtggacttcaactccagcgacgccgccgtctactggggcccctggaccaaggccagggccacctggtacggccagcccaacggcgccggccccgacgacaacggcggcgcgtgcgggttcaagcacaccaaccagtacccgttcatgtcgatgacctcctgcggcaaccagccattgttcaaggacggcaagggatgcggctcttgctacaagatcagatgcaccaaggaccagtcgtgctccggcaggtcggagacggtgatcatcaccgacatgaactactacccggtggctccgttccacttcgacctcagcggcacggcgttcggcaggctcgccaagcctggcctcaacgacaagctgcgccactccggcatcatcgacatcgagttcaccagggtgccatgcgagttcccggggctcaagatcgggttccacgtg

SEQ ID NO: 1675 - DNA, 634 bp, Artificial
  Synthetic
ccaaaaaaaaaggaaaaaaaaaaaccaaaacacaccaagccaaataaaagcgacaatgggatcgctcaccaccaacatcgtcctcgccgtcgccgtggtggccgcgctggtcggcggcgggtcgtgcggcccgcccaaggtgccacccggcccgaacatcacgaccaactacaacgccccgtggctccccgccagggccacctggtacggccagtcctacggctccggccccgctgacaatggtggcgcgtgcgggatcaagaacgtcaacctgcctccctacaacggcatgatctcctgcggcaacgtcccaatcttcaaggacggcaggggatgcggctcatgctacgaggtgaagtgtgagcagccggcggcgtgctcgaagcagccggtgacggtgttcatcacggacatgaactacgagcccatctcggcgtaccacttcgacttctccggcaaggcgttcggcgccatggcttgcccggggaaggagaccgagctccgcaaggccggcatcatcgacatgcagttcaggagggtgcgctgcaagtaccccggcggccagaaggtcaccttccacgtcgagaagggctccaaccccaactacctcgccgtgctcgtcaagttcgtcgcc

SEQ ID NO: 1676 - DNA, 561 bp, Artificial
  Synthetic
aaaagaacgtcgtcctatagatctctcccaggggataccggcaaagaggacgaacctacccctgcgcagtcatgattcattttgtggtactcattagccggcaggggaaagtgcgattaaccaagtggtactctccttatgctcaaaaggaaaggacaaagatcattcgagaacttagtggagtgatattatcaagaggtccgaaactttgcaattttgtggaatggcgaggcttcaaagtagtctataagcggtatgctagcttatatttctgcatgtgcattgatggggacgacaatgaattagaatgccttgagataattcaccactacgtcgagattctcgatcgctactttggaaatgtttgtgagctagaccttattttcaattttcacaaggcttactacatactagatgaggttttacttgctggggagcttcaagaaactagcaagaagtccgtcgcccgtgtcatcgctgcacaggacacgctagttgaaaatgccaaggaggaggcgagctctctctctaacatcattgcacaagccacaaagtgagaaa

SEQ ID NO: 1677 - DNA, 630 bp, Artificial
  Synthetic
agaagtataaccttgttctctcacattcaccttagcagaagcagaagaaggaagaggaggaggtgtttgttctttggatcaccaatcatgattcactttgtgctgctcattagccggcagggaaaagtgaggctaaccaagtggtattcaccatatacacaaaaagagagaaccaaggtaatccgtgaactaagtggtatgattctctcccgaggaccgaagctttgcaattttgttgagtggagaggatataaagttgtttataaaagatatgcaagcctgtacttctgtatgtgcatagaccaagacgacaatgagttggaggtcctggaaatcatacaccattatgttgagattctggaccgttacttcggaagtgtctgtgagctggatttaatcttcaattttcacaaggcatactatatattggatgaacttgtgattgctggtgaactccaagagtcgagcaagaaaactgttgcacgtctaattgctgcacaggattctttggttgaggctgccaaagaagaggcaagttctattagcaacatcattgcacaggccacaaaatgaaagatggagtgcattactgtttttatggttctcattcattgctgtaatcagatcttg

SEQ ID NO: 1678 - DNA, 689 bp, Artificial
  Synthetic
ccccacacccctattggttgttgtactagggggatcctggttacattgaagatccatctttcaaccggaagaacgtcaattccaaaaacccaagcaaaccaaaaccaggcaaagttctcttttcaattgaataaagtcaaagtaatctattgctgattccttaatcaaaatcgagaagaaatatggggatcagattcgtattaatggtaaataagcaagggcaaactcggctggctcagtactacgagtacctcactttagaagaaaggcgtgctcttgagggtgaaattgtgcgtaaatgccttgctcgcaatgaacagcagtgttcatttgtggagcatcgtaattacaaaatcgtgtacaggcggtatgcatcactctttttcctggttggagttgataatgaagaaaatgaacttgctattttggaattcattcacctgttagttgaaaccatggatcgtcattttggcaatgtgtgcgagctggatataatgtttcatcttgaaaaagcacacttcatgctggaggagatggtaatgaatgggtgtgttgttgagacaagcaaggcaaacattctggctccaattcagctaatggaaaaggcatcataagtagtacactctgatccatggaattcgtaataaaccgatttgcttgtgtagtgtttacgttttgggatttgtgct

SEQ ID NO: 1679 - DNA, 426 bp, Artificial
  Synthetic
gttggaagggattcgggagagaagaagagagagagagagagagagagagagaggggggatgacgatccgattcatactactggtgaataagcaggggcagacaaggctcgcacagtactacgagtacctcaccatcgacgagcgtcgcgcccttgaagctgagatcgtccgtaaatggctcgctcgcaccgattcgcagtggtcttttggagagcatcgcaactacaaagttatttacaggcgttacgcatctctctttttcttggttggagtggatatggatgagaatgagctggccatattggagtttatacatttcatggtggagacaatggaccgctattttggaaatgtgtgcgagcttgatataatgatccacttggagaaggcgcatattatgttggaagaaatggttatgaatgggtg

SEQ ID NO: 1680 - DNA, 788 bp, Artificial
  Synthetic
cccccgagcaagcaaaggaaagaacttcccttgcaccaccacctgatcagagaagtagctagctgcaggagagaaaccgaccaacaatggcggagtactactccagcaccgtggacgagtgctacgagaccaccggcaggcagcacggccacgggcacggccacggtcacgggcacgggcacgggcatggtggcatgagggtggagtcccacaccgacgactactacagcgagggcggcgagatcgaccgtgggaggaggaacaactccatgcactcgcaggagtacctgatgaggcagcagagcggccatggcggctacggctacggcggcggccagcagcaggagtactacaagcgggaggagcgcgagcacaagcagcgcgagcgcgtcggcgagatcggcgccctcgccagcggcgccttcgctctctatgaggggcaccaggcgaagaaggacccggcgaacgcgcagaggcacaggatcgagcagggcgtggcggcggtggcggcggtgggcgccggcggctacgcctaccacgagcaccgcgagcagaagcaggccagctacggcgccaaggagcagcagtacggctacgccaggatgccgcagcagcagggctactactgcaactgattaattattaatcaccccccaaattattaataatccatgcgtacgtacgtaccactaaataaatactggctactacgtacgtatatatacggtacaataagatgagcaaggatgtacgtacgtacacgtatatacgttgctcacccacaattt

SEQ ID NO: 1681 - DNA, 781 bp, Artificial
  Synthetic
cgactaactctgtctgaaggaagctaagattattaatcagtgagtagctagccatggctgaggagaagaagcaccaccacctgttccaccacaagaaggacggggaggaggagagctccggcgtggtggactacgacaaggagaagaagcaccacaagcacctcgagcagctcggcggcctcggcgccatcgccgccggcgcctacgctctcgtaagtcattaattagtacatttgaccaccactattacaagaaaatcgattttcgcagacgtatatgtcatcccccactttaactaacctatatgttttagccgcttggaaaaatcgattatgtagtggtgaactatgatctaatgataactacctagccatagctgattaattaagagataattaacggagaatttatttgtggtacgtcgttgcagcacgagaagcaccaggcgaagaaggacacggagaacgcgcacgggcacaaggtgaaggaggaggtggcggcggtggccgcgctgggcgccgcggggttcgccttccacgagcaccacgagaagaaggacgccaagaagcacgccgccgaccaatactagatcgatcccgatcgaatgaacgcaagaacgaacggtttatatgcttaattactttctccccataattacatgtatgcatgtggttgatggcttaatttgcttcttcttgttcgtcgtcatacgtcgtcgcttttacttcgtgttcatgtacattaattctgtatccgcactgagtattaaataagtgcgttt

SEQ ID NO: 1682 - DNA, 863 bp, Artificial
  Synthetic
cccacgcgtccgcccacgcgtccggccacatcttattgtcacttccatctcattctcctaattgtcatcactagcttctagctagcttaattaattaattagccatggcggaggagaagcaccaccaccacctgttccaccacaagaaggacgacgagccggccaccggagtagactcctacggcgagggcgtctacacgtcggagacggtgaccaccgaggtggtcgccggcggccaggacgagtacgagaggtacaagaaggaggagaagcagcacaagcacaagcagcacctcggcgaggccggcgccctcgccgccggcgccttcgccctgtatgagaagcacgaggcgaagaaggacccggagaacgcgcacaggcacaagatcacggaggagatcgcggccacggcggcggtcggcgccggcggctacgccttccacgagcaccacgagaagaagaaggaccacaagagcgccgaggagtccaccggcgagaagaagcaccacctcttcggctgatcgacctcatcacaacgtcgccggcggcggcgacgacctcgccgtacgtcgccggccgccgtgtcgtcgatttgtgtgtgtaataatttgtcttcttctgcatgcgtggtgttgctgtttttcacaagagtctccggcctcgaccagtgagaggctgacaggtggggccgtgagttcagcttgtgttgcttgattttctctgcagccttgccctctgtgtgtccaaataagtggtgtgcatggctctctccgtgtcatgtatcaatgtatttttatctgtactttgtacaagtgaagcaatatttatcgaaccttgactttctccattctatgggaaaaacc

SEQ ID NO: 1683 - DNA, 724 bp, Artificial
  Synthetic
gagaaaccgaccaacaatggcggagtactactccagcaccgaggacgagtgctacgagaccaccggcagggagcacggccacgggcacggtcacggtcacgggcacgggcacgggcatggtggcatgacggtggagtcccacaccgacgactactacagcgagggcggcgagatcgaccgtgggaggaggaacaactccatgcactcgcaggagtacctgatgaggcagcagagcggccatggcggctacggctacggcggcggccagcagcaggagtactacaagcgggaggagcgcgagcacaagcagcgcgagcgcgtcggcgagatcggcgccctcgccagcggcgccttcgctctctatgaggggcaccaggcgaagaaggacccggcgaacgcgcagaggcacaggatcgagcagggcgtggcggcggtggcggcggtgggcgccggcggctacgcctaccacgagcaccgcgagcagaagcaggccagctacggcgccaaggagcagcagtacggctacgccaggatgccgcagcagcatggctactactgcaactgattaattattaatcacccccaaattattaataatccatgcgtacgtacgtaccactaaataaatactggctactacgtacgtatatatacggtacaataagatgagcaaggatgtacgtacgtacacgtatatacgttgctcacccacaatttcgccgcc

SEQ ID NO: 1684 - DNA, 1011 bp, Artificial
  Synthetic
gataaacattaaacaagctgtgtgaacttcttttttcgtgacaagtttaattctttctcgatcgatcgtcgtgatggctgacgagtacggccgcggcggctacggcaggtccggcgccggcgccggcgacgactacgagagcggcggctacaacaggtccagctccggcggcgccgacgagtacggccgccggccgggaggcggtgccggtggctacaacaagcccggtggcaccgacgactacgacagcggctacaacaagtccgccggcggcgacgacgacgactacggccgcaccggcggcggcgggtacaacaagtccggcaccgacgacgactacgacagcggctacaacaacaggtcaggggctaacgagaagtacggccgcaacaagtccggcgacgacgagtacagcggcggcggcggcgccgaagccgacgaggagtacgtcgacgggttgtcgtcccgggacgacccggagaagtacaggaaggaggagaaggagcacaagaacaaggagcgcctcggcgaggtgggcgccctcgccgccggcgccttcgccatgtacgagaggcaccaggcgaagaaggacccggagaacgcgcagcggcacaggatcgaggagggcgtggcggcggcggcggcgctggggagcggcgggttcgcgttccacgagcaccacgacaagaaggaggccaagcaggcggcgaaggacgccgaggaggaggcggaggaggagtccggctccggcgcccgcggcggcgaggggaagaagaagcaccacctcttcggctgatgatccatcgatcgatcgcgccatgcatgcggcggcggcggcgccatggccggcgtccgcgcgcacgcgtaaggtgtggccatgggcgtgtgcagctgaataagagccggggtttttgtacgtatgggctcagtatgtgtacacctcgtatatggtatggatgtacgtataagcgtatagtgtgtactataccaataaagctatctgttgctctg

SEQ ID NO: 1685 - DNA, 781 bp, Artificial
  Synthetic
catcttattgtcacttccatctcattctcctaattgtcatcactagcttctagctagcttaattaattaattagccatggcggaggagaagcaccaccaccacctgttccaccacaagaaggacgacgagccggccaccggagtagactcctacggcgagggcgtctacacgtcggagacggtgaccaccgaggtggtcgccggcggccaggacgagtacgagaggtacaagaaggaggagaagcagcacaagcacaagcagcacctcggcgaggccggcgccctcgccgccggcgccttcgccctgtatgagaagcacgaggcgaagaaggacccggagaacgcgcacaggcacaagatcacggaggagatcgcggccacggcggcggtcggcgccggcggctacgccttccacgagcaccacgagaagaagaaggaccacaagagcgccgaggagtccaccggcgagaagaagcaccacctcttcggctgatcgacctcatcacaacgtcgccggcggcggcgacgacctcgccgtacgtcgccggccgccgtgtcgtcgatttgtgtgtgtaataatttgtcttcttctgcatgcgtggtgttgctgtttttcacaagagtctccggcctcgaccagtgagaggctgacaggtggggccgtgagttcagcttgtgttgcttgattttctctgcagccttgccctctgtgtgtccaaataagtggtgtgcatggctctctccgtgtcatgtatcaatgtatttttatctgtactttgta

SEQ ID NO: 1686 - DNA, 1024 bp, Artificial
  Synthetic
agaactgatgtgagagatgtagaagttttgagtgagatttatatctctatcaatgacaattacaaatcttacaaagactttaaggtgcttgatgctttggataaggctttagtggatagatatcgatccccttatagtgctatttctgctttggtttctttatgttatcatatctttgactttaataagtttaagttgctgtttaattgtgaagggaaatttgtggataagaagctgagaaaagacttcgagtggtgaactctaggtcctgatgtttaaatctactgtatttaccttcgcattaattaagcatgaagatcattttcgtctttgctctccttgctattgctgcatgcagcgcctctgcgcagtttgatgttttaggtcaaagttataggcaatatcagctgcagtcgcctgtcctgctacagcaacaggtgcttagcccatataatgagttcgtaaggcagcagtatggcatagcggcaagccccttcttgcaatcagctgcgtttcaattgagaaacaaccaagtctggcaacaactcgggctggtggtgcaacaatctcactatcaggacattaacattgttcaggccatagcacaacagctacaactccagcagtttggtgatctctactttgatcggaatctggctcaagctcaagctctgttggcttttaacgtgccatctagatatggtatctaccctaggtactatggtgcacccagtaccattaccacccttggcggtgtcttggcggccgcttatccgtatgatgttccggattatgccgagctctacaaacagctgttgaattttgatttgctgaagttggcgggtgacgtggaatctaaccctggtcctaggtctagaatggctactttctcttgtgtgtgttgtggtaccttaactacaagtacttactgtggtaagagatgtgagcgaaagcatgtatattctgaaacaagaaataagagattggaactttacaagaagtatctattggaaccgcaaaaatg

SEQ ID NO: 1687 - DNA, 592 bp, Artificial
  Synthetic
gaactagtgtcctgcaacaatgaagatcattttcgtctttgctctccttgctattgctgcatgcagcgccacagcgcagtttgatgttttaggtcaaaatattaggcaatatcaggtgcagtcgcctctcctgctacagcaacaggtgcttagcctatataatgagttcgtaaggcagcagtatagcattgcggcaagccccttcttgcaatcagctgtgtttcaactgagaaacaaccaagtcttgcaacagctcaggctggtggcgcaacaatctcactaccaggacattaacgttgtccaggccatagcgcagcagctacacctccagcagtttggcgatctctacattgaccggaatctggctcaagcgcaagcactgttggcttttaacttgccatctacatatggtatctaccctaggtactatagtgcaccgggtagtattaccacccttggcggtgtcttgtactgaattttcacaatattgtagttcggaagtgaaaatataagctcaggtatcatcggatgtgacatgtgaaacttaaggtgatataaatagaaataaaattatctttcatatttaaaaaaa

SEQ ID NO: 1688 - DNA, 230 bp, Artificial
  Synthetic
accgagactcgggccacgatctgccaattggcggagctagacggagtatggcatagcgccaattgctcagagcagctgagcttgcgcaattggccctcatcacaaggattcagccctccctctggaggttcagcttcattgatattgcgaggtggtgtctactgtacatactatacaatattcagcacaggagctttcggtaccaaaacccttcaacaccgaaaaaaaaa

SEQ ID NO: 1689 - DNA, 97 bp, Artificial
  Synthetic
acgcccacgcgtacgatttggcaattcctcaagctcacccatttgttgactactggcagtgtagcacacagtctgctacaacaaaccacatcaccat

SEQ ID NO: 1690 - DNA, 695 bp, Artificial
  Synthetic
aacatttggcaattcctcaagctcacccatttgttgactctggcagtgtagcacacagtctgctcaacaaaccacatcaccatgtccgccgaagagaagaccacggtggcgaccgacgtcgcaaatccccccagtcgcgagcatgaagttgtccacggcgacgagagcaatgtcgacgtgcctctagatttgcccgcaggatggaagtacaggcagattagccttttcggctacaagatgccttggtacgcgtcgccccgtgtccagctcctcatggttgcttttgtctgcttcatgtgtcctggcatgttcaacgcgcttggtggtttgggaggtggtggtcgtgccagcgcgaccttggctgacaacatgaacaccgccctctacagcgcatttgctgtcttcggattctttggtggcaccatcgttaacaaactcggtgttaaatggacactcgctttcggcggcatcggctatggtatttacgccatcagcctgctggtttccctccataagaccgaacagggtttcagcattttcgctggtaccttccttggtatctgtgccggtcttctatggactgctcagggcaccatcatgatctcctacccaaccgagaaagagaagggccgatactttgcctggttctgggctatcttcaacatgggcgctgtcgtgggcagtcttattcctct

SEQ ID NO: 1691 - DNA, 711 bp, Artificial
  Synthetic
aaaaggtagggcacacgacaaacttggccccgtcagcaaccagcgcacggcatgcctcagggaaggccaagtcccagcagatgatgagtccgacacgaccccagggagtatcaaacgccctgtgcggcgtcaatccatcggctgtcagatgatctctctcggggtgccacaagttcttcttctggtagcgtcccagaacggcgccgtccggaccgataaagtacgccgcattcgcaattccttcagtcatggaggcattgccttcctccgcagggatgggctctaggatcgtgcccggagcaatggcgatgccgagctccttggcaatggcctgatattttgcaagatacggcgtctgctccttggccgttgcgaggaggatcttggagtcgggcttccatgagccgagatggtactcaggaaggacgaccaggttcgcgccctgggaggcggccttgcggatgtatgactctgcgcgagcaaagttgccagctacatcgagcggctagagttggtgaacaattaggagacaagatcagccttcataattgcttcagctgcagcaggggttgttggtggcacacgggcgacgaatgccaagcaatacgtcagatacgcaaactcaccttggaatacagctgaaccagcgcaatcttcaaattcgacgccattgtcacagaaaatcaaatgctaacacaagtcaaagtgtac

SEQ ID NO: 1692 - DNA, 529 bp, Artificial
  Synthetic
gctacccatctatcaacaataaacctatcaaccaagacacatgacaccacccccaaaacaaaccccacacacaaaccgccacaatgcctttcaccggatccgacatcatcaagatcatctgcgccgtcgtgctcccgcccctcggtgtcttcctcgagcgcggctgcggtgctgacctcctcatcaacatcctcctgaccgtcctcggttacatccccggcatcatccacgccctgtacatcatcctcaagtattagatgcgtcgccatcaggcaccagcatgagcgcgcaccacccacccgccacctgctacgccgagcaaactctacgtgaacccaccaaacatacgatacccccaaagcgagaggaaaggaagcatgcagcggcggcataatttacacattgtgttgaattacggaacggatcgccgagctttgacagcgaggcgaggcaacccttttttacgagcttgcttttatgagattgagtagtaatgtctgtactacaattctgaaaaatcatccaccta

SEQ ID NO: 1693 - DNA, 891 bp, Artificial
  Synthetic
gtgccttgttgcagcatcccgtaacccctgcaggataccgccctaagccgcccaatttctcgtcactggctctagctttttgctgtttatcccgaaatgggcatcgaatggcttctgttccctccccccctatgatgtgtggcttgaccagtcgatgacgcaaacatggaagccggcttcctttctccttcttggtcggaatgcctgggaagggccaagatgacgagccacggcaataaatagtacaagcttcgcagaaaccttcttgtccgctcttctcccttttgtgtctcacacagcttttcttcatctttactccgcgatcttcttgatcttcaccaaaacaacatcattgcgcccttgaagccctcttagcaaatattcgatatacccaaaaggcattgagcccttgagccttacgagaaacacatatatccaacatgcctttcaccgctagcgatatctgcaagattattcttgccatcattctgccacccgtcggtgtcttcctcgagcgaggctgcggtgcagacctcttgatcaacatcctcctcacaatcctgggttacttccctggtatcatccacgctctgtacatcatattgaaatactaagcccgccttccgctcccgtatcccgccggattcaaagcgtcatgtcgtcgcaccgcatcatgttgtgcagacaccaattactcccacgtttgaccggcaattgtcgttttagaatggatgcgtcagtggaggagtgaaggttacggtcgccggctcaccacgtggccggtcatagacgccataatgacagtgggctttcctttatggcttttcttttgttttttcttttcctctcttgttggctggaggcagatgcaccctatttgaaagggggcgt

SEQ ID NO: 1694 - DNA, 224 bp, Artificial
  Synthetic
atatgttgctggttatggtacaattaatacttgaagatgatgtagagggcatggatgataccgggaatgtatccaagacaacagaggaggacgttgatgagcaggtcagcggtgcatcctcgctccatgaaaactccaacgggggggaggaagatagcaacgatgatcttgagaatgtcggaagaggtgaaagccattgtgtttgtgtttgcggacgcgtgggt

SEQ ID NO: 1695 - DNA, 846 bp, Artificial
  Synthetic
aacgggcctccatcgactccagaccatccacgacctacacggaagtggcaagagatcgaaatcgtctgcagcttacccctgcaacggccttaacaagctcccgactcggcgggaagctatagcgatccaagccgctcttgtctcgtatataaccaagagctagacttcgcattagatagttcttcgtccttgtgtctgaggacaactcccttcttcattacatacaattgattcaacctgaccacaatggctgacgttcagtccattcgggcattcggcaaagcccgctccaccatcgagggcaagcccctgtctgacgaagaaatcaagcaatacaatgattatttcaaagccagctgctacctttctctgggtatgatctacctgcgagagaaccctctccttcgcgagcccctcaagaaggagcacttgaaatctcgtcttcttggacactttggttcagctcccggacaaatcttcacatatatgcacttcaaccgtctcatcaaaaagtacgatctggatgcctatttcgtgtccggccccggtcacggtgcccccgccgttctttcgcagtcttatctcgaaggtgtctattcggaagtctacccagacaagtcacaagatatccaaggcctccagaaattcttcaagtatttctctttcccaggcggtgttgggtcccatgcaactcccgagactccaggctctatccacgaaggaggagaactcggatactctctttcacatgcctttggctctgtgtatgactaccccaatctcatcgctgtcaccatggtaggtgatggtgaggcagaaactggtcctttggctactgcttggcat

SEQ ID NO: 1696 - DNA, 580 bp, Artificial
  Synthetic
  misc_feature (3)..(3): The residue at this position can be any nucleotide.
gaaacctatggtaagggcgtaggcattgacagacgtctggttagaggtagctgttcgacttgcagtcatggtgaacgttccaaaaacaaagaaaagcttttgccagggcaaggactgcaagaagcataccttgcacaaagttactcagtacaagaagggcaaggacagtctctacgtgcaaggtaagaggcgttatgaccggaagcaatctggatatggaggtcaaaccaagccagtctttcacaagaaggctaaaactaccaaaaagattgtactgaagcttcaatgccagggttgcaaacgtgtaactcagcatcctatcaagaggtgcaagcattttgaaattggtggtgacaagaagggaaagggaacatctctgttctgagctgttgcattgcttttgtcttcttttttagtcttgatctttatctcgatgtagtccaattaaagcttaatttaaataccccaacggatcctatctggttctgtagttgcttcagatatcagattaatgacaatgtagtttatttgagaattaatatcaactcttaccattattatgaatcggattccccactgg

SEQ ID NO: 1697 - DNA, 467 bp, Artificial
  Synthetic
acctcaccgcccttcgacgaccgaaataccgtcaaaatggtcaacatcccgaagacgcgcaggacctactgcaagggcaaggaatgcaagaagcacacccagcacaaggtcacccagtacaaggctggcaaggcctccctcttcgcccagggtaagcgtcgttacgaccgtaagcagtccggttacggtggtcagaccaagcccgtcttccacaagaaggccaagaccaccaagaaggtcgtcctcagattagaatgcacttcgtgcaagaccaaggcgcagctcgctctcaagcgctgcaagcacttcgagcttggtggtgacaagaagaccaagggtgccgctcttgtcttctagatgggtgcataacggttatggcgctagggatgatgatggagcggtctgtgcatgtagcctcctcgagtacatgatccttgagggctcggaatcaaagcttcgtttctccg

SEQ ID NO: 1698 - DNA, 504 bp, Artificial
  Synthetic
aagcaaaggcggtttctactgcagctccttccttgcctgaagtcagcctccgaccatggtgaacgttccaaaaactaagaagacgtactgcaagtcaaaggagtgcaaaaagcacactctgcataaagttacacagtacaagaaaggaaaagatagcctagcagctcaaggcaagcgtcggtatgatcgcaagcagtctggttatggtgggcagacgaaacccgttttccacaagaaggccaaaactaccaagaagattgtgctaaggttgcaatgccagggttgcaaacatgtgtcccagcacccaatcaagagatgcaagcactttgaaattggtggagataagaaaggaaagggaacttctctcttttaagtggcgcattcacggagatgaaattgtttatttttgtgtcgtggtggacttttttatcaagtgtagctcaacaatgtttcttttgcatattgaacaatgtatgtctatggtataatacttatatttcgagt

SEQ ID NO: 1699 - DNA, 510 bp, Artificial
  Synthetic
aacagcaaaaccatatcttgatgattcaaaatatagagttaacaagcaaagatgagacaatcttgtacgagagagctaaaacaaatggattccaaatccagcaagtacaaaaatcgcagaaaataagatgaaaccaacttaaaacagagatgttccctttcccttcttgtcaccaccgatctcgaaatgcttgcacctcttgataggacgctgcgaaaagtgcttgcagctttgacactgaagcctcaaaacaatcttcttcgtggtcttagcctttttgtggaagacaggcttagtctgaccaccataaccagattgtttacggtcataacgacgctttccttgagcagcaagactgtctttacccttcttgtattgggtaaccttgtgcaaagtatgctttttgcattccttgttcttacagtaagtgttctttgtctttggaatgttcaccattttcgcgtctctgatctccggtgaagcttttgtgccgtcgtccggacgcgtggg

SEQ ID NO: 1700 - DNA, 528 bp, Artificial
  Synthetic
aggggagggcgcgctctgaagcagccatggtgaatgttccgaagaccaagaagagctttgccaaggcaaggatgtaggaagcatacgcttcacaaggtcactcagtacaaaaaggggaaggatagcttgtatgtgcaaggaaagaggcgttatgaccgaaaacagtcgggatatggaggtcaaactaagcctgtcttccataagaaggcaaagaccactaagaagattgtccttaagctgcaatgtcagtcttgcaagcgcgtgattcaacatcccatcaagagatgcaagcactttgaaattggaggtgacaagaagggaaaggggacttccctgttctaaatctcatcatttttctatcagttttggcttgggatccctgatcttattgtgttggagctcttccttattccatataagagctaattcttagtctttctgagttcctactgtatgaacttattataatccaatgcacaattatggctactcttactattatatgaacttattgtcatccgatgcacg

SEQ ID NO: 1701 - DNA, 535 bp, Artificial
  Synthetic
cccccgagggttttcggcaccgagctcgcgccgccgccatcgcacccaccgaaggagggagaggaacccaaagctcggcgccatggtgaacgtgccaaaaactaagaagacttactgtaagaacaaggaatgcaggaagcacaccctacacaaggttacccagtacaagaaaggaaaggatagcctttctgctcaggggaagcgtcgttatgactgcaagcagtcaggatatggtgggcagacaaagcctgtttttcacaagaaggccaagacaacaaagaagatcgttctgaagctgcagtgccagagctgcaagcactactctcagcacccgatcaagaggtgcaagcactttgaaatcggtggagacaagaagggcaagggaacttcactcttctaagatgctgatattgccctgttccccaattctctgccaggagttagcattaagaatgttcttgtcttgcctttctagtacaagttatatatcctcttgttttcagtcaggtctttttgatacataactacactacta

SEQ ID NO: 1702 - DNA, 400 bp, Artificial
  Synthetic
taatcctcgactcgcgacaatggtgaacgtacctaagacaaagaagacctactgcaaatccaaggagtgcaaaaagcacaccttgcataaggtcacacaatacaagaaaggaaaagatagtcttgctgcccaggggaagcgtcgttatgatcgtaagcagtcaggttatggtggacagacaaagcccgtcttccacaaaaaggcaaaaactacaaagaagattgtcttaaggttgcaatgccaggggtgcaagcatgtctctcagcacccaatcaagaggtgcaagcattttgagattggtggggacaagaaaggaaagggaacctctcttttctagattgcctgtgatgcaaaatttgatagttttctgttatacgtttttagatatctttttttgttg

SEQ ID NO: 1703 - DNA, 653 bp, Artificial
  Synthetic
catttctgtctcactcttcgccggcgacaatggtgaacgttcctaagacaaagaagacctactgtaagtcaaaggagtgtaagaaacacactttgcataaggtcacacaatacaagaagggcaaagatagcttagctgctcaaggaaagcgtcgttatgatcgcaagcagtctggatacgggggtcaaacaaagcccgtcttccacaaaaaggcaaaaacgacaaaaaagattgtgttgagattgcaatgccaggggtgcaaacatgtttcgcagcacccaatcaagaggtgcaagcattttgagattggcggggacaagaaaggaaagggaacctctcttttctagattgcctgtgaagcggaatgtaacagatctttcacccccttctgttctgttacactgttcagatactttggtaatatttgatgtagtgcaggagtttctgttattgaatcatgtgatcaattttgtgatgtcttagagaatctgataaggagagaaaatgaatattttaagtttttggtttagtatcttgttgcctaaatctattgcaagaaagttatgctgctctacctcacttggctgcatcaatttgtatgttgggattatattataggttgttttctccaaactagtgtatattgaaacact

SEQ ID NO: 1704 - DNA, 625 bp, Artificial
  Synthetic
tttgtcatactttctgattgggaggggagggtgagctctcttctgaagcagccatggtgaatgttccgaagaccaagaagagcttttgccaaggcaaggattgtaggaagcatacgcttcacaaggtcactcagtacaaaaaggggaaggatagcttgtatgtgcaaggaaagaggcgttacgaccgaaaacagtcgggatatggaggtcaaactaagcctgtcttccataagaaggcaaagaccactaagaagattgtccttaagctgcaatgtcagtcttgcaagcgcgtgattcaacatcccatcaagagatgcaagcactttgaaattggaggtgacaagaagggaaagggaacttccctgttctaaatctcatcatttttctatcagttttggcttgggatccctgatcttattgtgttggagctcttccgtattccatataagaactaattcttagtctttctgagctcttactatatgaacttattatagtccaatgcacaattatggctactcttactatatgaacttattatcatccgatgcacaattatgactactcttactatatgaacttataatccgatgcacaattatggccaatttttaaaagccgaaaa

SEQ ID NO: 1705 - DNA, 301 bp, Artificial
  Synthetic
aaacgaagtactgtaatcgtacgtactcaattgacgggctttcgacccctgttttgcatctgcggtcgaataaacaccgactgcatctccatcagattgcgcttggcggccgggtctactgttgcagttgatgccgcccaactctggcaaaacctggcgctgcggctgcggctggagaccgggggagcgattctggctgcccaaacgagaaccgggggggatgtcaatgcacagttgcatcgaaatttggcgattaatttttttacgagggaggattaggattaggactttgcacggtagg

SEQ ID NO: 1706 - DNA, 134 bp, Artificial
  Synthetic
gttcaggagtccacctacgtacttgacgtatgcatttcacaaaaacggagtacagctggactcatgaggagcaagggataaacgtctgtctagcaattggcgtgatatggccgcttaggataaatcatatgatc

SEQ ID NO: 1707 - DNA, 683 bp, Artificial
  Synthetic
gtcctcagacgcttgcattaagtagacatcattgtgtctactcccagtcatcgtcgacaacttctttgatacaagattgcaagactctatccaagtatggctaccccaggtaccgaccccatcgagggacaatacaacaaagaatccgcggccgacgtgcccaccaacgggcactatgtttccaatggcatgggctctggacagcaattccagccccagcagtatcagcagtatccgggctatggacaatttgttccgtttagcaacacccaagatcctcgggctgggcctcaccaggccatgatctcccaggtctaccaacctacccttggtaagattggtaacccaggtcctcttggtctgatcggtttcgctttgacgaccttcgtgctcggactttaccagtgcggtgctggtctccctaattccaacccattgggcaacgtcggccctgatcaagctgtcttcggtgtggctgtcttcttcggaggcatggctcagtttgttgctggtgtcatggaatttgtccttggcaataccttcggttgtactctccactgttcatacggggctttctggcttgcctttgccatgttctcagtccctacactgggcatccaggccgcttataacggagatcaacgtgcctttagctttgctgttggcattttcctcatcatatg

SEQ ID NO: 1708 - DNA, 584 bp, Artificial
  Synthetic
atcttcaagttcattgctgatcgtgccggcgacttgcttggcttcgctcacgatggtgttgcctttttgaccacacctgccgtggccgcgcttccctggttcttctttggcgtcatcccagccatcatcttcttcatctccctggtgcaggtcctgtactacattggcttcatccagtggttcatcaagaaggtggccatcttcgtcttctgggctctcaatgcctccggtgccgaggccgtcgtcgctgccgccacccccttcatcggccagggcgagtctgccatgttggtccgtcccttcgtcccccacatgaccaatgccgagcttcaccaggtcttgacctgtggtttcgccaccatttccggctccgtccttgttggttacattggtcttggtctcaatgctgaggcgctcgtctcctcctggatcatgtctatccccggctccctcgccatctccaagcttcgctatcccgagactgaggagactcttaccggcggccgtgtcgtcatccccgacgacgacgagcacaaggctgaaaacgccctgcacgcctttgccaacggtgcttggctcggaat

SEQ ID NO: 1709 - DNA, 422 bp, Artificial
  Synthetic
tcgacccacgcgtccgaaacaatctcagatcttcatctcaactttcaatcttccacacaagcaaataaccaaccaaccaaccaatcacaatggattccatcaagcagggcgccaactacgtcggtgagaaggttcagcaggccacctctggtgcctccaaggagaccaacaagcaggtcgccaaggactccgatgcctctgtcggcactcgtgcctccgctgccaaggacgctctcggtgacaagatggacgagtccaagcacgacgccaagggcgaggcccacaagcaggccatctaaatggactgagtgagagggaacgatgacaacacttttgcttctaccccgtcttgagagacaaatagtcgatacccctatgagaactcaataatacaactttttcagccgaaaaaaaaaagaaaa

SEQ ID NO: 1710 - DNA, 605 bp, Artificial
  Synthetic
aggtttcgaactctttccttctcctcctcctcctcccgttccctgcgccgaggaggaagaagaaagagccaggccaactcagagaggaggaaagaggaaagaggaaagaagaagaaggaccatcccccgcgcgctatccacacttgtgcagaactatttgacgctaacatgatcaagctatttagtgtcaagcaaaaacaaaaagaagctgctgaaagtgcaaatgggaggcctcaagtcaggaaacaaagtgctggggaattgcgtgtacagaaagatatcagcgagttgaatttgcccaaaacaacttccatatccttccccaacgggaaaaatgatatgctgaattttgaaataagcatttacccagatgaaggctactatcgtggtggaacttttttcttcactttcaatatttccccattgtatcctcatgaagccccaaaagtgaaatgcaagaccaaggtatatcatccaaatatagatttggaaggcaatgtctgtctaaacattctccgggaagattggaaaccagtcttgagcatcaactcaataatatacgggcttcaatatcttcttctggatccaaacccagatgatcctct

SEQ ID NO: 1711 - DNA, 713 bp, Artificial
  Synthetic
cgataagagagaagaaaagaacccatttgctggctcttacgctaacctgagatcacacaaatcctcttttttcttcagcttttttgtgccttctcacttaagcagggaccatgattaagttgtttaaagtaaaagaaaagcagagagagcaagctgagaatgcaaatggaaagccaccagtcaagaaacaaagtgcaggagagttgcgtcttcacaaagatataagtgagctaaatctacccaaaacatgtagcatatcatttcccaatggaaaagatgacctcatgaactttgaagtcactattcggcctgatgaaggatattatatgggtggcacatttacgttctctttcagtatttccccaatgtatcctcatgaagccccaaaggtgaagtgcaagacaaaggtttaccaccctaatattgacttagaaggaaatgtgtgtctcaacattcttcgagaagactggaaacctgtgctcaacattaacaccattatctatggtctatatcatctgttcacggagccgaatcacgaggatcccctcaatcatgacgcagctgctgtattaagagacaacccaaagttgttcgagtccaacgttagaagggcaatgcatggaggctatgttgggcaaacgttctttcctcgctgtatgtaacatctttacttctgaatcaactgatttaagaagctgatggtggaagtttga

SEQ ID NO: 1712 - DNA, 634 bp, Artificial
  Synthetic
ttgcgggtgtcaacaagcttctgcgcaccttgtctccttcgatcaccctcaaggtaggagataaaacatggcgatggcaatgggtatgaagcccggaaagcctggcctcgaggagcctcaagaagccctccatcgcatccgtatcaccctttcttccaagagtgtcaaaaacctcgaaaaagtgtgtgcggatttggttcgaggtgccaaagaaaaaaagttgaaggtcaaggggcctgttagaatgcccacaaaggtgttgcgccacaccaccaggaagtccccttgtggagaaggtaccaacacgtgggattgttttgagctgaggatacacaagagaatcattgatttgcacagctcttcagaagttgtgaagcagatcacctcgattacaatcgagcctggagtcgaggtggaagtgacaattgcagatgtctgagtgtagtcaattatttctttttgaccgggaaaaggttattgacttggttgaagagggatgactggtctttcaattttaggttatgtttctccttatgaatatttgttaggatttttgacatttaatcctgtgttaacggagaattgagctggatagtattttggaatcatttcttagcaacccatattaccttta

SEQ ID NO: 1713 - DNA, 641 bp, Artificial
  Synthetic
cccacgcgtgcgcacaaattcacaaccgcaaaaaatcctctcccggcttaaaaacgagtgataaagaggtgtaacaaaacatggcgtatgaaccgatgaagcccacgaaagctggtttggaggctcctctggagcagattcataagatcaggatcactctctcttcaaaaaatgtgaagaacttggaaaaagtgtgcactgatttggtccgtggagctaaggataagagacttagagttaagggaccagtgagaatgcccactaaggttcttaagatcactaccagaaaggcaccttgtggtgaaggtaccaatacttgggacaggtttgagctcagggttcacaagcgtgtcatcgatctcttcagctcccctgacgttgttaagcaaatcacgtctatcaccattgagcccggtgttgaggtcgaggtcactattgctgactcttagacacttgttccaaaaccgcttcaaaagaatgtattttatcgtttctggtcctacatttttgtttgcaaccttgtttcttgggttttgatagttctgaggtggtttttgtctatcgaatttttttcatctataagagaccttaatgaaccaaaaaaaaaaaacccaaaaagggcggccgcaccctaggccagt

SEQ ID NO: 1714 - DNA, 982 bp, Artificial
  Synthetic
ggcgcatttttgcggttccaatagatacttcttgtaaagttccaatctcttatttcttgtttcagaatatacatgctttcgctcacatctcttaccacagtaagtacttgtagttaaggtaccacaacacacacaagagaaagtagccattctagacctaggaccagggttagattccacgtcacccgccaacttcagcaaatcaaaattcaacagctgtttgtagagctcggcataatccggaacatcatacggataagcggccgccacatcagcgatcgtcacctcgacctcgacaccaggctcgatggtgatggaggtgatctgcttcacaacatctggggagctgatgagatcgatcacccgcttgtggatgcggaactcgaaacgatcccatgtgtttgttccttcaccgcacggcgacttgcgggtggtgatgtggagcaccttggtggggatcctgacggggcccttgacgcgcagctgcttgtccttggcgcccttcaccagatcagcgcaaaccttctcgaggttcttgacgttcttggaggagagggtgatgcggatgcgattgagctgcagctcccgcgcctcctccatgccgagcttcccgcccttcatcgcgccgccggcgccgtacaccgcagccgccgccatgcttaattaatgcgaaggtaaatacagtagatttaaacatcaggacctagagttcaccactcgaagtcttttctcagcttcttatccacaaatttcccttcacaattaaacagcaacttaaacttattaaagtcaaagatatgataacataaagaaaccaaagcagaaatagcactataaggggatcgatatctatccactaaagccttatccaaagcatcaagcaccttaaagtctttgtaagatttgtaattgtcattgatagagatataaatctcactcaaaacttctacatctctcacatcagttctacctaattttgtga

SEQ ID NO: 1715 - DNA, 679 bp, Artificial
  Synthetic
cggacgcgtgggcgagcaccaccaaccccaccccccgagcgagcggagcggagaacgcgaggcgaggcgaagcaaacatggcggcggctgcggtgtacggcgccggcggcgcgatgaagggcgggaagctcggcatggaggaggcgcgggagctgcagctcaaccgcatccgcatcaccctctcctccaagaacgtcaagaacctcgagaaggtttgcgctgatctggtgaagggcgccaaggacaagcagctgcgcgtcaagggccccgtcaggatccccaccaaggtgctccacatcaccacccgcaagtcgccgtgcggtgaaggaacaaacacatgggatcgtttcgagttccgcatccacaagcgggtgatcgatctcatcagctccccagatgttgtgaagcagatcacctccatcaccatcgagcctggtgtcgaggtcgaggtgacgatcgctgatgtgtaatgctgccaaactagcactaccttagacctacctgtcttgtttctctgctgcttagaatctcggttccgattgccatgcgtgtaacggacatccaactggtttagtgtatctgggtcttttatatgtgcgcggatgctatggatctttctcatgtaagaggtgtgtaactcgccagttttgcttcaaccacatgaaatttggtattggaa

SEQ ID NO: 1716 - DNA, 713 bp, Artificial
  Synthetic
cgaaaaaccctaacgccacccgcgccgccatccccgagcaccaccaaccccaccccccgagcgagcggagcggagaacgcgaggcgaggcgaagcaaacatggcggcggctgcggtgtacggcgccggcggcgcgatgaagggcgggaagctcggcatggaggaggcgcgggagctgcagctcaatcgcatccgcatcaccctctcctccaagaacgtcaagaacctcgagaaggtttgcgctgatctggtgaagggcgccaaggacaagcagctgcgcgtcaagggccccgtcaggatccccaccaaggtgctccacatcaccacccgcaagtcgccgtgcggtgaaggaacaaacacatgggatcgtttcgagttccgcatccacaagcgggtgatcgatctcatcagctccccagatgttgtgaagcagatcacctccatcaccatcgagcctggtgtcgaggtcgaggtgacgatcgctgatgtgtaatgctgccaaactagcactaccttagacctacctgtcttgtttctctgctgcttagaatctcggttccgattgccatgcgtgtaacggacatccaactggtttagtgtatctgggtcttttatatgtgcgcggatgctatggatctttctcatgtaagaggtgtgtaactcgccagttttgcttcaaccacatgaaatttggtattggattcaatttttgtc

SEQ ID NO: 1717 - DNA, 619 bp, Artificial
  Synthetic
aagaaaaccgaagctgcggctacgtcttttacatcttcgtcgcatctccctcagcaaatcaaatcaaatcaaaatatggcgtatgcagcaatgaaggcaacaaaaccagggctagaggagccccaggagcagattcacaagattagaatcactctttcttccaaaaacgttaagaatcttgagaaagtgtgtgctgatctggttcgtggtgccaaggacaagaggctcagggtaaaaggacctgtgcgaatgcccactaaggttctcaacattaccactagaaagtctccctgtggagaaggcacaaatacatgggacaggtttgagctgcgggtgcacaaacgtgtgattgaccttttcagttccgcagatgttgtcaagcagatcacctcaatcaccattgaaccgggtgttgaggttgaggtcaccattgctgattcttagattcttctctgttttcattaggttgttgaatttttttcaagtactagtggtttgcagttgctttcttggccgtctaaattatgggcttaaggttttctttattccaattaaagttttgcagctaaaccagatactaatactatttgatattgggaagaggatttgtccgttaaaa

SEQ ID NO: 1718 - DNA, 524 bp, Artificial
  Synthetic
aagaaaatagagaagggggagaaaagaagagagcctcttagaggatgatgctgaatgacgctgtggatggtgaaatgtgagatgagcaaggtttgtgttacatgtatattaagaggattttttctttttgtggacggttttttatatgtgatattatggagaaactagcaaggatggagaaaagggggagaaaaggaacgataagtttatctctgtttgggcatgtatgggtgttaatatgattgacttgtcatatgtgaatgatgagtagatgatgtgatcaacacttggatgagagactcacaaccagatttacgagtcattcatctatacagacataaacgctgagaacgtcatcggaggtattgcttcacttcacatcttgatgctatatgtagctggccgcatttcgtttgctggaaagaggtgcacggattaagatgcaagtagcacatgtacggttgagaaactcaggaacacaaaagatgtacattaaactcccattctagagaacctatttacag

SEQ ID NO: 1719 - DNA, 543 bp, Artificial
  Synthetic
  misc_feature (358)..(358): The residue at this position can be any nucleotide.
ggacctggccgacaacatctccgctgtcaacgcccagattgccttcatcgccatcttcatcgccttcttcgcctccacctggggtcccggtgcctggattgtcattggtgaaatcttccctctgcctatccgatctcgtggtgttgctctgtccaccgcttccaactggctgtggaacaccatcatcaccgtcatcaccccctacatggttggtaccgataagggcaacctgaagtcttccgtcttcttcatctggggaggtctctgcacttgcgctttcgtctactcctacttcctcatccccgagaccaagggcctgtctctcgagcaggtcgaccaagatgatggaggagaccancccccgtacctctggcaagtggaagcctactaccaccttcgctgctcagatgggcactggtgagtacattgagaaggctgtcgttgaggtctaagcgtttcctgcgtcgatttggataaaggaggtgttcttttttcttttttcttccctttttactatttcctttataacgtggtggggtggat

SEQ ID NO: 1720 - DNA, 358 bp, Artificial
  Synthetic
cccacgcgtccggcccagaatcacataaaaagcacggacacaaaaagcacaaaaacaagaataaggacaagagaaaaaaaagaggcagctcatagttagggcaaggaaaagggcgggatggagggtaccgtgacaggcgctggatgccggtccagaatagcctcatcggcaagcaccgtgtgattggatccgtggtcccgtccaaccagctgggacacgcgttcattcgcccaagggacggacaggaagcccgcaggcccttgcgaacacgggacagcgatggggcccgtggtgatgatgatgagatgatgatatcgcccgggagaagacgaagggaggaagcagatggacggcgtac

SEQ ID NO: 1721 - DNA, 214 bp, Artificial
  Synthetic
gtggatagcggatggatacttgcagtaatatggggtaagtgagtgagtgagtgagtgatatggatacagcgggatgatgatgatggtggtggtggtggtgttgtcactgatgttgtcgagtgagttgtttgttttgtttacctttggaattgattgaaatgaaatgaaatgaaacagcccaatgcacagcctaagtccaaagaaaacaaaccag

SEQ ID NO: 1722 - DNA, 684 bp, Artificial
  Synthetic
tgtcttgtcattattactcgaccgcgtcgagccaagaaaccattgaagcacataacaaaccgttcgaaaaccgcaacaatgtctatcgtccagccacaagaataccagaccgttgacgacgtgccgtatcagcgaggccgtcctctcccaacagtcacccccgtcttccagaacaagctgcccaactcgcctggcaagacgtccatcggcctcctcgtcgacttcccgcccaactcgtcgacgcccccccacacgcacggcggcgcggccatctccgtcttcgtcatcaagggcaccgtgctcaacaagatgaacgatggcccgactcgtgtgatcccggcgggcggcacgtggttcgaggcccccggctgccaccaccggaccagcgacaacttcagcaccacggagccggcgcagattctggcgacgatggtggttgacacaaagactgttgaagagggagggatggcggctcttgttgtgctcgacccggagtatgctgatatcagacttggttaaattgatatggatgctgcagtgaagagaaccggaagctcggaaagggtgtgggtgttgtcaatatcagaagtggccagcggaggctcggattgctgttagtaaacggggcatctcagcaggaaggcaaaatgaatatgtaaagcaatcaatggcaacgaatcgttt

SEQ ID NO: 1723 - DNA, 584 bp, Artificial
  Synthetic
aggagagagggagggagagggagagggagagggagagagagaagtcgaaaaccggctaatcttctcctctaatcatgtcgctgatcgccaacgaggatttccagcacattcttcgtgttctcaacacgaacgtagatgggaggcagaagatcatgttcgccctcacggcgatcaagggtatcggccgacgtttcgccaatctcgtctgcaagaaggcagacgtcgacgtcaacaaaagagctggagaactctctgctgcagagttggaaagccttatggtgattgttgcaaatcctagacagttcaagatccccgactggttcctgaacagaaagaaggactacaaagatggacgcttctctcaagttgtgtccaatgctttggatatgaagctcagggatgaccttgagaggctcaaaaagatcaggaatcaccgaggtcttcgccactactggggccttcgtgttcgagggcagcacacaaagaccactggccgccgaggaaggactgttggtgtctctaaaaagcgtgaggggggtaattctagttccttgtcgtggctggcatttagaaatgtctcaatt

SEQ ID NO: 1724 - DNA, 374 bp, Artificial
  Synthetic
aggtatataaactatttattaacagacaaggcctacagacttatttcttcttggacacacccacggtgcggccacggcggccagtggtcttggtgtgctggcctcggacacgaaggccccagaagtgacgcagccctctatgggcccgaatcttcttcagtcgctccaggtcttcacggagcttgttgtccagaccattggctaggacctggctgtattttccatcctttacatccttctgtctgttcaaaaaccagtctgggatcttgtactggcgtggattctgcataatggtgatcacacgttccacctcatcctcagtgagttctcccgccctcttggtgaggtcaatgtctgctttcctcaacaccaca

SEQ ID NO: 1725 - DNA, 774 bp, Artificial
  Synthetic
gcatctctttcaaactaaagcagccgcagccgcagccgcactgtgccgaaagcagtgaaaccctaaccatgtcgctggttgcaaacgaagagtttcagcacattcttcgtgtgcaaaacacgaacgttgatggaaagcagaagatcatgttcgctatgacctctatcaaaggtatcggtcgccgttttgctaacattgcttgcaagaaagccgatatcgacatgaacaagagggccggagaactctctgctgcagagcttgatagcttgatggtggttgtggctaatcctcgccaattcaaaatcccagattggtttttgaacaggcagaaggattacaaggatggcaagttttctcaagttacatctaatgcacttgatatgaaactcagggatgatctggaacggctgaagaagatcaggaatcaccgtggtttgcgtcactactggggccttcgtgtacgtggtcagcacacaaagaccactggccgcagggggaagactgttggtgtctccaagaagagataaatcatttacttgccagttcctttatgttttatgcttctctttggtatgtggagtccgaacacccgcaggaagtttattaggtattttgtaatgtttgcactggaattttctagtcttgccatttggagggttatagttcctataaatcctctggcggcattgcaagcatttgtttattgtgggatcaaagttttgccggttttacgcttgaattattacattgattgagtactttttattgagatgc

SEQ ID NO: 1726 - DNA, 661 bp, Artificial
  Synthetic
cgaaccctcgcagccgcatcgcgccggcgcctcctcctccccctccccctccccctccggcgagagagcccgcgccgttgccgccgccgccgccgccgccatgtcgctgatcgcgggggaggatttccagcacatcctgcgtctgctgaacacgaacgtggatgggaagcagaagatcatgttcgcgctcacctccatcaagggtgtcggccgccgcttctccaacatcgcatgcaaaaaggccgacatcgacatgaacaagcgggctggtgaactcactcctgaggagcttgagcgcctcatgactgtggtggcaaaccctcgccagttcaaggtccctgactggtttctgaacaggaagaaggactacaaggatgggaggttctcccaggttgtttctaacgccctggacatgaagctcagggatgaccttgagaggctgaagaagatcaggaaccaccgtggtcttcgtcactactggggtctccgtgtccgtggtcagcacaccaagactactggcaggaggggaaagactgtcggtgtctccaagaagagataaattccatgcccatcagcacagcaaatgcgttttgcttatcttatgagcgtttcaatgatgtcagtcttgatagggcattttgttggatgatgcttttgtcta

SEQ ID NO: 1727 - DNA, 322 bp, Artificial
  Synthetic
cccccccccaccgtggtctccgtcactactggggtctccgtgtccgcggtcagcacaccaagactactggcaggaggggaaagactgtcggtgtctccaagaagagataaattccatgcccatcggctcagcaaattcattttgcttgtcttatgagcgtttcaatgatgtcagtcttgataggcagttttgttggatgatgcttttgtctaagaagatagatcgtgcgttgcaggaatctcaaaacttttatatattgtaacttggttgtttggtaccgcaaattctgaagcctaatttttttactggatgtgtttctggt

SEQ ID NO: 1728 - DNA, 447 bp, Artificial
  Synthetic
cccacgcgtccgcttttgtgttcttcactctccagcgatcgtttattgcttgaagacggcttcttcttctcacaaatctcatctctgctaatcaaaatgtctctggttgcaaatgaggagtttcaacacattcttcgtgtgttgaatactaatgttgatggtaagcagaagattatgtttgcccttacctctatcaaaggtattggtaggcgattggctaacattgtctgcaagaaggctgatgtcgacatgaacaaaagggctggtgagttatctgctgctgagattgataacctcatgacaatcgttgcaaacccacgtcagttcaagatcccagactggttcttgaacaggcagaaggattacaaagatggcaagtattctcaagttgtctccaatgctcttgacatgaagctgagagatgatcttgaacgtctcaagaagatc

SEQ ID NO: 1729 - DNA, 259 bp, Artificial
  Synthetic
aaacctcatctctgctaatcaaaatgtctctggttgcaaatgaggagtttcaacacattcttcgtgtgttgaatactaatgttgatggtaagcagaagattatgtttgcccttacctctatcaaaggtattggtaggcgattggctaacattgtctgcaagaaggctgatgtcgacatgaacaaaagggctggtgagttatctgctgctgagattgataacctcatgacaatcgttgcaaacccacgtcagttcaagat

SEQ ID NO: 1730 - DNA, 557 bp, Artificial
  Synthetic
gatctttctcggcatccaaaaatgtctctagttgcgaacgaggagtttcagcatattctgcgtgtgctcaatactaatgtcgatgggaagcaaaaaattatgtttgctttgacctcaatcaagggtattggaaggcgattggctaacattgtgtgcaagaaggctgatgttgacatgaacaagagggctggagaactaagtgctgctgagattgataacctcatgacaatcgttgctaaccctcgccagttcaagatcccagactggtttcttaacagacaaaaggattacaaggatgggaaatactcccaagttgtttccaatgctcttgacatgaagttgagagatgatcttgagcgtctcaagaagatcagaaaccatcgtggtctgaggcactactggggtctccgtgtacgtggacagcacaccaaaaccaccggacgccgtggaaagactgttggtgtttccaagaagcgttaaaaagagtttgagcttggttcaatggctttgttttgttttttttgtattgttgttttttgcggccgcaattctcgagc

SEQ ID NO: 1731 - DNA, 531 bp, Artificial
  Synthetic
accggtcgacccataactacacgccaaaatgtccctcgtcgtcactgaacaaggcaacttccagcacattcttcgactcctcaacactaacgttgacggccgaatcaaggtcatgtacgccatgtgcaagatcaagggtgttggtcgacgatacgccaacctggtctgcaagaaggccgatgtcgatctctccaagcgagccggtgagctcaccgtcgaggagctcgagcgaatcgttactatcatccagaaccctggtcagtacaagattcccggctggttccttaacagacagcgagactttaccgacggtaaggactcccagctgctcgttaaccagcttgatgtcaagctgcgagacgatattgagcgactcaagaagatccgagcccaccgaggtctccgacactactggggctacaaggtccgaggtcagcacaccaagactaccactcgaaagggtaagatcatggctcaccgaggttaaaacgtgcatgtacatgtaaaattattaaaatgctattgaggacc

SEQ ID NO: 1732 - DNA, 573 bp, Artificial
  Synthetic
acgcgtcggtttgtaggcggctcggcggcgaagatgtctctggtgagcaatgaggagtttcagcacattcttcgtgtgctcaacaccaacgtggatgggcggcagaagatcatgtttgcgctcacctccatcaagggtatcggccgccgcttcgccaacattgtctgcaagaaggccgatgtggacatgaacaagagggctggtgagctgaccgctaccgagctcgagaacctgatgctgatcgttgccaacccgcggcagttcaagatccccgagtggttcctcaacaggaagaaggactacaaggacgggaggtactcccaggttgtggccaacgctctcgacatgaagctcagggacgacctggagaggctcaagaagatcagaaaccaccgtggtcttcgtcactactggggtctccgcgtccgcgggcagcacaccaagaccactggacgccgtggaagaactgtgggagtgtccaagaagcgatagatagccgcagcttttgtttggtctcttaatttccaatatgttttaagtgcaaattttaaaattcattaagaaaattaattt

SEQ ID NO: 1733 - DNA, 682 bp, Artificial
  Synthetic
cccaaaaccctaaccctcgcagccgcatcgcgccaccgcctcctcctccccctccccctccggcgagagagcccgcgccgttgccgccgccgccgccgccgccatgtcgctgatcgcgggggaggacttccagcacatcctgcgtctgctgaacacgaacgtggatgggaagcagaagatcatgttcgcgctcacctccatcaagggtgtcggccgccgcttctccaacatcgcctgcaagaaggccgacatcgacatgaacaagagggccggtgagcttacgccggaggagctggagcggctgatgaccgtggtggcgaacccgcggcagttcaaggtgcccgactggttcctcaacaggaagaaggactacaaggacgggaggttctcccaggttgtctccaacgcgctcgacatgaagctcagggatgatcttgagaggctcaagaagatcaggaaccaccgtggtctgaggcactactggggcctccgtgtgcgtgggcagcacaccaagacaaccggaaggaggggtaagactgtcggtgtgtccaagaagcgataagcctaagaaccacccgagacttgatgaagcgtttcgttgggtgatgttttgccctaggataatattttgcagctatggaaccttgtcgtaatgtatcttgaagagtgtctttgggaacta

SEQ ID NO: 1734 - DNA, 747 bp, Artificial
  Synthetic
ctcacatctcttgaatacagaagaagccgccgccgcacagagcaagatttgaaacctagcaatgtcgctcgttgcaaatgaagaatttcagcacattcttcgtgtgcaaaacaccaacgtcgatgggaagcaaaagatcatgttcgctttgacctcaatcaaaggtatcggtcgtcgttttgccaacattgcctgcaagaaagctgatatcgacatgaacaagagggcgggagaacttactgctgcagagcttgacagtgtgatggtggttgttgcaaatccccgtcaattcaaaatacctgattggtttttgaataggcagaaggattacaaggatgggaagttttcacaagttacctctaatgctcttgacatgaagcttagggatgatctcgagcgcctgaagaagatcaggaatcatcgtggtttacgtcactactggggtctccgagtgcgtggtcagcacacaaagaccacagggcgcagggggaagactgttggtgtctccaaaaagagataaatcatctacttgttcagtttgttatgtgctttctctttatgtgctccgggcgatacatgtttaagatattttaggggattttgtgttggtatgcttaaattttcctttccgttggtggattacagtataatttttttccatagtgacaaggatttctctgctttatgatctaggttttgcaagatgatcttgaattaaattgaatgagtatttccttaaatatactc

SEQ ID NO: 1735 - DNA, 630 bp, Artificial
  Synthetic
gccattacggccggggagggttttggtagttctgcatctcttcaggagtgaacgaaacagccgcaccgcggagcagaattcgaaactgtagcaatgtcgctggttgcaaatgaagaatttcagcacatacttcgtgtgcaaaacacgaatgttgatgggaaacagaagataatgttcgcaatgacatctatcaaaggtatcggccgtcgtttcgctaacattgcctgtaagaaagccgatatcgatatgagcaagagggcgggtgagctttctgctgctgaactcgatagcttgatggtggttgtggcaaatcctcgccaattcaaaatccccgactggtttttgaataggcaaaaggattacaaggatggtaagttttcgcaagttacatctaatgctctggacatgaagcttagggatgatctggaacgcctaaagaagatcaggaatcatcgtggtttgcgtcattactggggtcttcgagtccgtggtcagcacacaaagaccactggtcgtcgggggaagactgttggtgtctccaagaagcgataatctcctttcccctgagccagttttgcatggttatgctattttgtttttatatgcagcaacaaagtttgaatggagtta

SEQ ID NO: 1736 - DNA, 739 bp, Artificial
  Synthetic
  misc_feature (675)..(675): The residue at this position can be any nucleotide.
gttctttcttcttggagggtgtgtcgtagtttagctattggggaggggtagggataggatagaggcagaaagagaacaggaagaagaaagaagccggcgaagggtaagaaggggttttcctcagctctcaaccatgtctctgatcgccaatgaggatttccagcatatcctgcgtgtcctgaacacgaacgtggatgggcggcagaagatcatgttcgccctcacggccattaagggtatcgggcgtcgcttcgccaacctcgtttgcaagaaggccgacgtcgatgtcaacaagagagctggggagctttcggcggctgaacttgaaagcttgatggtgattgttgccaacccaaggcaattcaaaatccctgattggttcttgaatagaaagaaggactacaaagatggtcgtttctcccaagttgtatccaatgccttggacatgaagctcagggatgatctggagcggcttaagaagatcaggaaccaccgaggtcttcgtcactactggggccttcgtgtgagaggacagcacacaaagaccactggccgcagaggaaggacagttggtgtctccaagaagcgatagtcacctatattcttcttgctggcggattttttttatacatgttttgtcaatcttgatatcagaaatcgatgcagacggacagnccccccttctttgaccgtatcgcattggcaggatcctttagtttctaatgaacacaacggaagt

SEQ ID NO: 1737 - DNA, 923 bp, Artificial
  Synthetic
gcttttctcctgggattttcgagtgcaaacatctgcccttgtttgcgtctttccgcctgcgcaaaccagaacaccgcacttcctcccgagacagaaacgagtgttggttgccccagactgtctttgattctgagacatttggcctcccttgcaggtaactgacggtgagaataaaagccgacgggccgccgcctgcagcaaacgaaaccagcgacatacaaaaagaaacacaaacaagcaaatcaattcccgagcaagaaaaaaagaagaagcccatcatgaagatgctttcgtttgccgccctctcggtgctcgtgttgggcgcttcggccctggctgcgccgccggcccaccccccggccgacaatgggtgctgctgctgcgacatcaacaagaagagaatcgactgcgacaggtcgatcccggcgtcggagtgcatctgcccccaggtcatctgccccgccggcgcgcccacgttcacgcacggcacgccgccgaaagccaccccaccgcccacgccgctgccgacttacaagcagtgctgctgctgcaatcccaacattaacaagattgtgtgctcgctgaggctcgtggaggactgtatctgcttggccgtgatgtgtccgacggatgcaaagaccatctttgtcaggccaactggcgttccgactgtcgcttaagagtattcgttggcgagccgacttgcctgaatcctggaccggggacatgacatggggggagggaaaatacagggcaaggcattgctgatggtgaatgcacaacacgcgtggcagactggccgaaaattgatgatttactgatgggcgactttggacttgaaatggggcatgccggatgggttacttgacagtatttacaccatttctattcaacaataaatggaattctctagataaaaaaaa

SEQ ID NO: 1738 - DNA, 582 bp, Artificial
  Synthetic
cccacgcgtccgcccacgcgtccgcccacgcgtccgttctcctccaggttgcagcaaaagcacaggaagcagcgagatggaaggcaagagccggcgaccggagataaccgtcgtgccggcggcaggcggcggcgccgccgccgccgttgatgcggtgaaggcggcgaacaaggagcccatcagcccgggctcgccgtccctggcgagcggcgccggcaaggagagcctgagccgccatgaggccgccgtcgtgtccctgcccgcgtggaagctcgacgcgctctgccaggagtccggctcgtcgccggcggtgatgagggcgcgcttcccctacttctgaatttctgaatttctgatgaagccatgagctttttgccatcttcgtacgtgtgtgtgtgtgtgtgtgtgtgattgtaactgtgttgttcatggctgagtaaagaattatacttcctacaagcggctgtgatgtatatgtgagctgctttagctgacgcgttcatctttggacgctgtaaaaactaaaaactgccagtttttcatgtagcatcattggaaaaacatagccatctgtttgcgttg

SEQ ID NO: 1739 - DNA, 594 bp, Artificial
  Synthetic
ttgtaaagactccccctcaaggccccagaaaagacgaattcaaatctacgccgactgtctctctgcaatcgaaagctattcgtgcaaccattacacgtcaacaagccatcgatctcttaacaaacctttatagaacttgcgacaactttctaccgccatcatgggtgtctgtgccgcagtactaattgtcatcgtcaccatcttcttccctccgctcggcgcgtgggctgtggcaggatgtggaatggacctactcatcaacgtatgcttgacgatacttgggtatttcccgggtcacatacatgcgttctatctcgaatacgtgtattacgaccgtcggcaacaagcccgcgagggccattatccgccgcgtcgtgctcccggcatctactctgacaaggtgcaaacgggtggacaaggccgtcgacaaggctatggaacgatggcaccgccgcctgctgggcagcctgctggtgctggtgcgcctgtcgctggccctccctatgatagccaaggttataacaacaaccaaggctatgtaaatcagggctatgtcaaccaaggttatagcaaccaaggtcaaaaccagggata

SEQ ID NO: 1740 - DNA, 679 bp, Artificial
  Synthetic
gggcggacgcgtgggcggccaaatcccacacttcagactcagactcagactcacgctcagaaacagtcgtcacaatggatcccttggagagcatgtcaactggagggcccctgcccaaggacttcaatgccgacgatgcgggcaacatggaggatatggagaagcaatttgccgtcaaagttgtgcaacacatggcaacctactgggccattctcgaaaaggtcaagggctccggcctgcgactgacgaagatcgacgacgagatctacgaccacctcaaggaggcctttcccgagtttgaccccgccgccacgatcgacgaggaccagatgaagagcaagaccggcaaggagaggtggcgcgccttcatgatgaagtacgagaagaaggtggacgactacaactttggcaccatggtgcggaacaacgccaaggccgagtacgagcaggacacaaccattttcgtccccaggatgcagttttatgccattgagatcgcccgaaaccgaagcggcctcaacgactggatatacgaaaaggctcaggaagagaagaatagctccaaataaataccccaatacacaagccaattcaagagttgtttttgttatcaccgcgtgcctttgtcaactaaaaatattgaggattcactcaacgggcgtggatatggttttgtcat

SEQ ID NO: 1741 - DNA, 288 bp, Artificial
  Synthetic
caagcccaagtggagagaattcatgaacacgtacgagaacatcattgccgactacaactttggcaccattctgcgagttgatgcttccaagggctacactgagaccaacaccatgtttgtgcctcgaatgcagttcctggccattgaaattgctcgaaacaagtacggtctcaacgactgggtctaccagtctgacgcctaagcgcgcggacggagacgccaaacaccaccaacaactaatgttgggcaacgatagagcccgatagctaatgtcattatttatgatcg

SEQ ID NO: 1742 - DNA, 637 bp, Artificial
  Synthetic
aaacgaaaccgcaatccatctcccggcggaaattgccctccaaccgcaaccatgtcgaccctccccaggactctgggcaacctgcgcaagattggcatcaaggaatacttccgccagatgctggttcgtctctcgcccttctaacctcccacgacctctggctaacgcacagctcttcgcggtcctcctcgaatagtacatcggtgacaccaagtacggtactctcatcggccaggatcgcttcggcaacaaatactacgagaacctcgaggaactgcccctccgaacccgctgggtcgactacgccaagcacgactacgatgcctcccacatcgagcccggctggcacgcctggatcagctactccgtcgacaagcccccgacccaggacagcctcatcgccacgggcaccagacactttgagcccgcccttcccaagcccaactttaccggaacgcgaggcgcttacaagccgtataacacagtgaaatcgaagcttaatgcttgggagccggtggccaaggatcgggtatgagtggtttttacgttttcttttttaaaccgtgggaaaatatggtgtacatattgaaatcgcgcaacaaacgcaaacaaatcaaacaatagacacagacatgtg

SEQ ID NO: 1743 - DNA, 366 bp, Artificial
  Synthetic
agcaaaaatgccccctaaagtgcagcagaccaaggccgctaaggccgccgccgccatggccggaggaaagacccgaaagaagaagtggtccgcccagaagatgaaggataaggctcagcaccacgttatccttgaccagcccctgtacgaccgaatcttcaaggaggctgctaccttcaagctcgtctctgtctccgtgcttgttgaccgactcaagattggaggttctctcgcccgagttgctctccgagatctcgaggccaagggtatcatcaagcccgttgtcaagcactccaagcagtacactttcacccgaactgctgccgagtaaattagttattttatagctgaaaaaaatatgtattg

SEQ ID NO: 1744 - DNA, 1472 bp, Artificial
  Synthetic
gttgtttttttgtttttcatctttcttctttgtcacaatcactttgccgtcttccacggacatttccgcagatctgcatcacagagatctgcatcagagaggatttcaagcttttcctctttgtttgccttcctctcctcttctcttcttggatcacaaaacaatcggcaaaattgacatctcgatattttctgcctccaatcacagccgtcataccacctgtggcgtctttgccatcaattctctgctgcggtgctacccgccctgcagcaatttttcccgctggccgtctgcaggcttgcctcggctgtgggtttttcgtcgaccactgaggcttagtgcccatcagccactaaagcggcttgacgtcgattctcaactttgaacccttttgagctgcctctggcctctgcctcatctctcccacaccctcacgcgcgcagtcttgaatcaacaccccttcacgcactcgccattgccgcgctcctcgtcacgctctgctcgattagccgtctctcgcccattgattgaacctgctctcggcctctgcagccaccctcacgcaacctacgcctgacatcctctgcgtcgctcggctgtctcccggttttatccatcagctgaaccttcaccttcgccttcgctctcaagagggaatccgagggcccggccgttctctgccatctattgttattgccattaacgctgctgctgctgccactgtctcctctactcctgtttcgccctcatatgtctcagccgcctcgccggatgcctctactatcacaccctaaacaccgtattagcatacttgatcttaccaaactgccgttgcagtaacgccggcttcatcttcttgacaatgccgtcgaaaactaacaatggtgtgggagttcaggtcgaggacacaaagatatgcgttgtcatggttggtctcccggcccgcgggaagagctacattgcccagttagcccagagatacctgcaatggctgtcgattccggcagcgactttcaatgtcggcaactatcggcgcaatgacgctccacagccgactgccgacttctttgattttaacaatcccgaaggagagcggaagcgccgtgcggctgccgaggccgccgttgctgacatgcttgcctggttccgcaccggcggcgtcgtcggcatccttgacgcgaccaattctacaaaggagcgccgtaaatgggtcatggacacgtgcaccgctcacggcattgaagtgctctttgtcgagagcaaatgcgatgatgaagaggtcatcatggccaatatccgtgacgtcaagctaacgagccccgactatcgaggccaagatcccgaggccgcggcgcaagactttcgcaatcgcatcagccactacgagaaagtttacaagaccatcaacgccgacgaggatgaggacaactacacctacctaaagctgatgaacgtcggcaagcaagtcatca

SEQ ID NO: 1745 - DNA, 652 bp, Artificial
  Synthetic
gtttttctagggcaagccctcgcgatgattcggcggaatgcccgcctccggagggagtatttgtatcggaagagcttggaagggaaggagcgcgaggtctacgagaagaaacgcaagatcaagcaagcgcttcaggaaggcaagccattgccgactgagctgcggaacgaggaggcggttctcaggagggaaatcgatctagaggacgaaaacactgcagagcctactactcatgtcgatgacgagtatgcctacgctggagaggttgatccaaaaatccttctgaccacgtcccgtgatcccagcagtcgactgacgcagtttgtcaaggaactaaaggttgtctttccaaatgcacaaagaatgaaccgtggaggccaggtgatttcggagattgtagaatcctgccgagctcacgacttcaccgacataatcatggttcatgagcacagaggagaacccgacggtctgatcgtatgccatctgccgtatggtcctacagcgtattttggtctcatgaacgtggtgacaaggcacgatataaaagacaagaaaggcctgggaacaatgtctgaagctttcccacatctaatactaaacaacttcaacaccaagcttggacagagaacttccaacatacttaaatacctct

SEQ ID NO: 1746 - DNA, 647 bp, Artificial
  Synthetic
tgatgtttaaatctactgtatttaccttcgcattaattaagcatggcggaccagctcaccgacgaccagatcgccgagttcaaggaggccttcagcctcttcgacaaggacggcgatggttgcatcacaaccaaggagctgggaaccgtgatgcgttcgctggggcagaacccaacggaggccgagctccaggacatgatcaacgaggtcgacgcggacggcaacggcaccatcgacttcccggagttcctcaacctgatggcacgcaagatgaaggacaccgactcggaggaggagctcaaggaggcgttcagggtgttcgacaaagaccagaacggcttcatctccgccgccgagctccgccacgtcatgaccaacctcggcgagaagctgaccgacgaggaggtcgacgagatgatccgcgaagccgacgtcgacggtgacggccagatcaactacgaggagttcgtcaaggtcatgatggccaaggcggccgcttatccgtatgatgttccggattatgccgagctctacaaacagctgttgaattttgatttgctgaagttggcgggtgacgtggaatctaaccctggtcctaggtctagaatggctactttctcttgtgtgtgttgtggtaccttaactac

SEQ ID NO: 1747 - DNA, 654 bp, Artificial
  Synthetic
atcgatccatcgatccaccgggcatttcgtcaaagaggagatggctgatcagctgaccgaggaccagatcgccgagttcaaggaggcgtttagcctgttcgacaaggatggagacggctgtatcacaactaaggagttgggaacggtgatgcgatcgcttggacaaaacccgaccgaggcggagctccaggacatgatcaacgaggtggacgccgacggcaatgggaccatcgacttccccgagttcctcaacttgatggcgcgcaagatgaaggacactgactcggaggaggagctcaaggaggcgttccgcgtcttcgacaaggaccagaacggcttcatctcggctgccgagctccgccatgtaatgaccaacctcggcgagaagctcacggacgacgaggtggacgagatgatccgcgaggctgatgtggacggggacgggcagatcaactatgaggagttcgtcaagatgatgctagctaagtagtagaacatctgtttcctttttctctactttgttcctcgcctttcctctctctgtcttttctctttcctttttgttttggtaaagtcctgcttccatgttaggatgatgattccaccacgtctaaaaccttttaaattatttgttcctgtccttgcaaaaaaaaa

SEQ ID NO: 1748 - DNA, 521 bp, Artificial
  Synthetic
aggaacacagcagcaagcttggtgcttcgtcgtccggtacccctgttcttcgcagggcctgaaaaggaaggaagagttttaagcaagagacatcgatggccgcctctgctgccgagcagctcacacaggagcaattggcagagtttaaggaggccttcagcctgtttgacaaagatggcgatggctgcattaccaccaaggaactggggacggtgatgagatccctgggacagaaccccaccgaggcggagctgcaggacatgatcaacgaggtggacgcggacgggaacgggaccatcgactttgccgagttcctgagccttatggccaggaagatgaaggacaccgactcggaggaggagctcaaggaggcgttccgggtgttcgacaaggaccagaacggcttcatctcggcggtggagctgcggcatgtaatgaccaacctcggggagaagctcaccgacgaggaggtggacgagatgatccgggaggcggacgtcgacggcgacgggcagatcaac

SEQ ID NO: 1749 - DNA, 620 bp, Artificial
  Synthetic
cgccactcgttccccttccttcctctcctcctctcgcggaaccttctcgaagcttccacacccccaacctcgcctccaccaccaaccccccatggcggaccagctcaccgacgagcagatcgccgagttcaaggaggcgttcagcctcttcgacaaggacggcgacggttgcatcactactaaggagcttggaaccgtgatgcggtcccttggtcagaacccaactgaggcggagctgcaggacatgatcaacgaggttgatgctgatggcaatgggaccattgacttcccagagttcctgaacctgatggcgaagaagatgaaggataccgactctgaggaggagctcaaggaggccttccgtgtgtttgacaaggaccagaacggtttcatctcggctgctgagctccgccacgtcatgaccaaccttggtgagaagctgaccgacgaggaagtcgacgagatgatccgtgaggctgacgtcgatggcgatggccagatcaactacgaggagttcgttaaggtcatgatggccaagtgaggagggttcccattaaataagttctgtctgaagtgaactaaaactgtcagggcctacaacaaagctgtactttgtgatg

SEQ ID NO: 1750 - DNA, 701 bp, Artificial
  Synthetic
ctctccgcgacggtctgggcttccccacccctcgcctcctcgcgcgctcggtgagagaagcgaagaagaagaagaagaggaggaggaagaagccaggctaagccccgcggcatggcggaccagctcaccgacgaccagatcgccgagttcaaggaggccttcagcctcttcgacaaggacggcgatggttgcatcacaaccaaggagttgggaactgtcatgcgttcactagggcagaacccaacggaagctgagctccaggacatgatcaacgaggttgatgctgatggcaatggaaccattgattttcctgagtttctcaatctgatggctcgcaagatgaaggacactgattcagaggaagaactcaaggaggccttccgggttttgacaaggaccaaaatggcttcatctccgctgctgagctccgccatgtgatgacaaatcttggcgagaagctaactgacgaggaggtggatgagatgatccgtgaggctgatgttgatggtgatggtcagataaactatgaggagtttgtgaaggtcatgatggccaagtgagccatggaaccatactctaaagcagaggagattgtgtgttgcatagtcctagctaagatgcaacacttgttttatcaatttccagtgaagcatcctactagctgtagtcgctaaaaaggattttcctgctatgttcctctg

SEQ ID NO: 1751 - DNA, 784 bp, Artificial
  Synthetic
agccattctctccgcgacggtctcgtcttccccacccctcgcctcctcgcgcgctcggtgagagaagcgaagaagaagaagaagaggaggaggaagaagccaggctaagcccagcggcatggcggaccagctcaccgacgaccagatcgccgagttcaaggaggccttcagcctcttcgacaaggacggcgatggttgcatcacaaccaaggagctgggaaccgtgatgcgttcgctggggcagaacccaacggaggccgagctccaggacatgatcaacgaggtcgacgcggacggcaacggcaccatcgacttcccggagttcctcaacctgatggcacgcaagatgaaggacaccgactcggaggaggagctcaaggaggcgttcagggtgttcgacaaagaccagaacggcttcatctccgccgccgagctccgccacgtcatgaccaacctcggcgagaagctgaccgacgaggaggtcgacgagatgatccgcgaagccgacgtcgacggtgacggccagatcaactacgaggagttcgtcaaggtcatgatggccaagtgaggcaccacttcccctgccgatgatggcatagtaccctgggaggaggaaaccgtgcattgccgtattagtaaggggatgcaaacactggtttcagtcgtcttccctgatgaagaaaaccgaaccgtactagttgtagttgctgaacatttttctatctctccagtctctccggtgtgccatggaacttcttgcttgatttttctgtgtgaatctgtt

SEQ ID NO: 1752 - DNA, 723 bp, Artificial
  Synthetic
acccctctctctctgtctgtgcctctctctctctctctctctttatatatatatattctctttcctccggtcaaacgttgggagtagcatggccgaacagctgactgaggatcagatcgcagagttcaaggaagccttcagtctcttcgacagagatggcgatggttccatcaccaccaaagagctaggtacagttatgcgttctttagggcagaatccaacggaagctgagcttcgagacatgatcaatgaggttgacgctgacggaaatggaacaattgattttccagagttccttaatttgatggctcgcaaaatgaaggatactgattctgaggaggagctgaaggaagcatttaaagtctttgataaggatcagaatggctacatttctgctgcagagttgcgtcacgtaatgacaaatcttggagagaagctgactgatgaggaggttgatgaaatgattcgtgaagctgacatagacggggacggccaggttaattatgaggaatttgtgagaatgatgctttcaaagtaattccaaacttgttcttgttgccgttcgtattcaaatagcagatctactgctaacaaagatttgctttggcacataattgagccgctttttcatgtggaaggaggcaaaaaaaaggccacaaagttcaccagaacaattagctgctgtgtattttgaggtagtaggttatataacgtttgtagtgg

SEQ ID NO: 1753 - DNA, 725 bp, Artificial
  Synthetic
ttctctctctctctctctctctctctcactctgtccagctcctcctcctcctcagcaatggcagaccagctgacagaggagcaaatcgcagagttcaaggaagccttcagcctctttgataaggatggagatggttgcatcacaacgaaagagctgggtaccgtcatgcgttccttagggcaaaatccaactgaagcagagcttcgagacatgatcaatgaggttgatgctgatggaaacggaacaattgattttccggaattcctgaatttgatggcccgtaaaatgaaggacacggactctgaagaggagctgaaggaggcattcaaggtctttgataaggatcaaaatggctatatttctgccgccgagttgcgtcacgtgatgactaatttgggagagaagttgacggatgaggaggtcgatgagatgattcgtgaagcggacattgatggggacggccaggttaactatgaggagtttgtcagaatgatgcttgcaaaataaaatcccccattccttgcactcaatctaacacaaataggttgctaatttgctttttgggataggttgtattaagcttgcactccctaaggaatgaattgtttttttttctttcccttttttgttcatatagccatggctgaaatgcttgggcacaattatcagttatgcttcattgagacaccatacgggctttatgagcttgtgtaactttgatgaag

SEQ ID NO: 1754 - DNA, 560 bp, Artificial
  Synthetic
gttttggagagacggggagctgagatggccgaccagctgacggaggatcagatcgcagagttcaaagaagccttcagtctttttgataaggatggagatggttgcatcacaacgaaggaactggggactgtgatgaggtctctgggccagaatccaacggaaggagagctacaggacatgatcaatgaagtggatgcagacggaagtggaaccattgacttccccgagttcctcaacctcatggcccgcaagatgaaggacaccgactctgaggaggagttgaaagaggccttccgtgtgtttgacaaggaccagaatggatatatctctgccgaagagcttcgtcatgtcatgactaacttgggagagaagctgaccgacgaagaagttgatgagatgatacgggaggcggacgtggacggcgatggccaaatcaattacgaggaatttgtgaagataatgctgtccaagtgaggagaccgaacgggaatacttgggttgtgtgtgaggggactttctcttactcgtagcaattctttttgtgtgaaattgagcaacta

SEQ ID NO: 1755 - DNA, 611 bp, Artificial
  Synthetic
gaattcacaacagagactcggccatcataattccgcgttctctaaaatttaccttttagagatcccatcttcctcttgttcttcgttgatattatatcacacagggaagaaacaaaatcatggctgatcaattaactgacgaccagatctctgagttcaaggaagctttcagcttattcgacaaggatggagatggttgcatcacaaccaaggaactgggaactgtcatgcgttcactaggtcagaacccaacagaagcagagctccaggacatgataaacgaggttgacgctgatggaaatggaacaattgattttccagagttcctcaaccttatggcacgtaaaatgaaggatactgactcagaggaggaactaaaagaggcttttagggtattcgacaaggaccagaatggtttcatttctgcagctgagttgcgccatgtcatgaccaacctaggggagaagcttacagacgaggaagttgatgagatgattcgtgaagctgatgtagatggtgatggtcaaatcaactatgaggaatttgtcaaagtcatgatggccaagtaaggagactcatccccttaccactaaaaagggaaaagagaaaca

SEQ ID NO: 1756 - DNA, 595 bp, Artificial
  Synthetic
aatagatcctcctcaggcgatactgcttctgctcatcttctctccttcaatatctcgtccttggcagtagcgcgaatcgaacagcggtggaatggcggagcagctgagccctgagcaaatcgctgagttcaaagaggcctttagcctcttcgacagagatggagatggctgtattacaactcgggagctgggggtagtgatgcggtcgttgggtcagaacccaacggaatcagagcttgtagacatgattaacgaagttgatgctgatggcaatgggaccatcgattttgcggagtttctcaacttgatggcccgcaagatgaaggatactgactctgaggaggaattgagggaggctttcaaagttttcgataaggaccagaatggctttatctccgcttccgagctgcgccatgtgatgataaaccttggcgaaaagctgactgacgaagaagtgaaagagatgattcgggaggctgatacggacggggatggccaagtcaactacgaggagtttgtgaagatgatgctctctaagtgagtcgggaaagtcaaagtcaaaagcgaaaagtgaaaagtaaaaagtaaaaaaatt

SEQ ID NO: 1757 - DNA, 681 bp, Artificial
  Synthetic
gttccacgtgcttttctgctctcttttggtttcacgactgcccaactcaacctgcccagcgctctctctctctctctctctctcttcctggtttgggtttctatggccgcagtgatggtcgagcagcccctgacagaggagcaaatagccgaatttaaggaggcctttagtctttttgatagagatggagatgggtgcatcacaacaaaggagttgggcacggtgatgaggtcgttagggcagaaccccactgaggccgagatccaagacatgatcaatgaagtggatgcagacggcaatgggatcatcgacttcatggagtttgtgggcctcatgtctaggaagatgaaggatactgactcagaagaggagctcaaagaggccttcaaggtctttgacaaggatcaaaatggcttcatctcagcccttgagctccgccacgtcatgaccaacctcggtgagaagctcagtaacgaagaggttgacgagatgatccgagaagccgatgtggacggggatggccagattaactatgaagaatttgtcttaattatgatgagtagtaagtaagtaggacccccatatagaagcctcttaaacccttctctaagtcttgtgtgtactcatgaaaggaaacatccccagactgagccctttggtgtactaaagcatcaccaaagc

SEQ ID NO: 1758 - DNA, 668 bp, Artificial
  Synthetic
gcactcgatttgtcagccttggttgtcctgcccccctcaaccagcgggaagcttggttgccagataaggcgcttggtttgtccccccagcacggccgctggggatggcctccaggcgactccttccggccctcctccgacgcggcgctgcttcatcgtccccgtccccgatccgttctcctgcggtggcctcctcccgccactccggtagttgccgcccgcacaatgtagccctagcccggtctctccccttctccacgaaggcggctacctctcctcccgcctccctgtccccacctcctactcctactagcatgggggattacttctctggaaagggtagcgttggtaccattgcccaggtcatcggtgccgtcgtcgacgtcaagttccagactggcctcccccccatcctcacgtccctcgaagtgcagggccatagtatccgcgtcgtccttgaagtggctcagcacctcggagataacactgtccggaccattgctatggactccactgacggactcgtccgtggccaggaagtgctcaacactggcgcgcctatcaccattcctgtgggcagagcgactttaggccgcattatgaatgttgttggtgaaccaattgacgagcgtggcgacattgttacggatcactacttgcccatacata

SEQ ID NO: 1759 - DNA, 327 bp, Artificial
  Synthetic
cccacgcgtccggagggtcttgtccgtggaaggaaggttctcaacactggtgctccaatcactgtacctgttggaagagctacccttggccgtatcatgaatgtgcttggagaacccattgacgagagaggcgaaatcaagaccgagcattacttacctattcacagagatgctccggctttggttgatctagccactgggcaagagatcctggccactggtattaaggttgttgatcttcttgctccttaccaaagaggaggaaagattggtctctttggcggtgctggtgttgggaaaactgtgcttattatggagctgatcaac

SEQ ID NO: 1760 - DNA, 1154 bp, Artificial
  Synthetic
caaaccctcccccatggcttctcggaggcttctcgcctctttcctccttcaatcggctcaacgtggcggcggtccaatttcccgatcattaggaaactccatcccaaaatccgcttcacgcgcctattcacgcgcatcccctaagggattcctcttaaaccgcgccgtacagtatgctacatccgcagcagcaccggcatctcagccatcaacaccacccaagtccggcagtggaccgtccggaaaaattaccgatgagttcaccggcgctggctcgatcgggaaggtgtgccaggtcatcggtgccgtcgtggatgtgaggttcgatgaaggtttgccaccaattttgaccgctctcgaagtgttggataatcagatccggcttgtgcttgaagtggctcagcatttgggtgagaatatggttcggactattgctatggatggtaccgaaggacttgttcgtggtcaacgcgtcctcaatactggttctcctatcaccgttcctgtgggtagagccacacttggccgtatcatcaatgtcattggagaggcaattgatgagagaggcccaattactaccgatcactttttgccaattcatcgtgaagctcctgcctttgtcgagcaagccactgaacaacaaattcttgtcactggtattaaggttgttgatcttcttgctccataccaaagaggaggaaaaattgggctttttggtggtgctggtgtggggaaaactgtgcttattatggaactgattaacaatgttgcaaaagctcatggtggtttctctgtctttgctggtgttggtgaacgcactcgcgagggtaatgatttgtaccgagaaatgattgaaagtggtgtcatcaagctaggcgagaagcaaagtgaaagcaagtgtgctcttgtatatggtcaaatgaatgagccccctggtgctcgtgcacgtgttggacttacaggtttgaccgtggctgagcacttccgagatgccgaggggcaggatgtgcttctctttattgacaatattttcaggtttactcaggctaactcagaagtgtctgctttgcttggtcgtatcccatctgctgtcggttatcaaccaactttggctacggatcttggaggtcttcaagaacgtatcaccaccacca

SEQ ID NO: 1761 - DNA, 573 bp, Artificial
  Synthetic
actgctgaggttcttgagaccggtattggggtcgtcgacctcctcgccccttacgctcgaggtggtaagattggtctcttcggtggtgccggtgtcggtaagaccgttttcatccaggagctgattaacaacattgctaaggcccatggtggtttctccgttttctgcggtgtcggtgagcgaacccgagagggtaacgatctttaccgagagatgaaggagactggtgtcatcaacctcgagggtgagtccaaggtcaccctcgtcttcggtcagatgaacgagcctcccggagcccgagcccgagtcgcccttactggtctgaccattgccgagtacttccgagacgaggagggtcaggatgtgttgctcttcgttgacaacattttccgattcacccaggccggttccgaggtgtccgctctgcttggtcgaattccctccgctgtcggttaccagcccactctggccaccgatatgggtgccctccaggagcgaattaccaccacccagaagggttccgtcacttccgtccaggccgtctacgtgcccgccgatgatctgactgatcct

SEQ ID NO: 1762 - DNA, 614 bp, Artificial
  Synthetic
gtgctatggcgtcgaggcgggcgctgggacagctcctccgcgcggcatcgcggacatcttcgtcttctaccaggcaagcgtcgtcgctcttcccgggcggaattctcccggcatcgcggcgggcatctagggatcccctgggcgacggccatgcccttgccgggatcaggagcttcgccactgccgctgccgcgaagccgcagacggataccttgggctacatttcccaggtgattggagccgtggtggatgtcaagttcgacaaggatctgcccaacattctaaacgctctcgaggtccaagaccattccttccgggtcgtgctcgaggtggcgcagcatctgggcgacatgaccgtcaggaccatcgccatggacaccaccgatggccttgtgagggggcagaaggtcttgaacactggggctccaatcactattcctgttgggaggtgcaccttgggccggatcatgaacgtcattggagagcccatcgatgagcttggggattttgtcaccgatcatttcctgccgatccatagggaagctccggttttcacagagcagtccactgaacaggaggttctggtgacgggtatcaaggtggtggatcttctt

SEQ ID NO: 1763 - DNA, 284 bp, Artificial
  Synthetic
caacaaccgagtcttcaacgcccccttccgaggtatgggctcttccgccggcgtcggctctggtaagatcagaaccgttattggtgccgttgtcgatgtccagttcgagcaggataatctccccggtattcttaacgctctgaccattgatcgtggtgaagggtaacaagctcgtcctcgaggtttgccagcatctcggtgagaacaccgtccgaaccattgccatggacggtactgagggtcttgtccgaggcacctctgtcgctgacactggtgctcccatc

SEQ ID NO: 1764 - DNA, 668 bp, Artificial
  Synthetic
atttgcatatccatcgctgattgctctctgtcatctgccaagatgttcaagagcggcgtttcgtccctcgcaagggctgcccgcccatcaattgccgctcgacgagctatccgaccagccttcccccgatcccccatcgtcaggcttgcaagcactcagagcgttggagatggcaagatccaccaggtcattggtgccgtcgtcgacgtcaagttcgacactgccaagctgcctcctatcctgaacgccctggagaccaccaacaacaaccagaagctggtccttgaggtcgctcaacacttgggcgagaatgtcgttcgctgcattgccatggacggtactgagggtcttgttcgtggtgccaaggcttccgacactggtgctcccatcaccattcccgtcggccccgccactctcggtcgtatcctgaacgtcactggtgaccccattgatgagcgtggacctgtcaagaccgacaagttcctgcctatccacgctgatcccccctctttcactgaccagtccacctctgccgagattctggttactggtatcaaggtcgtcgatctgctcgctccctacgctcgtggtggaaagattggtctcttcggtggtgctggtgtcggcaagaccgtcttcattcaggagctgatcaacaacatcgccaa

SEQ ID NO: 1765 - DNA, 625 bp, Artificial
  Synthetic
aactgtatcacactacccatggctgctcgaaggttcctttcctgcatgttccgctcatccatacgtcactcttcttcaaaaccctcactcacaacccatatccatcgcccctctccggccggccaccttctccaccgcgccgtcaattacgccacatctgccgccgcaaaggcgacgccggcgcctcagaaaaaaacttctcctccgaaaattaaggaaactggcggtaagatcaccgatgagtacaccggcgccggtgccattggtagcgtatgtcaggtgatcggagctgttgtggatgtccggttcgatgaaggtctgccgccgattttgacggcgttagaagtgatggataatgatataaggttggtgctagaggtagctcaacatttgggagaaaatatggttaggactattgctatggatgggactgaggggcttgtgcgtggtcaaagagtcctcaatactggttcccctattactgtgcctgttggcagggctacacttggtcgtatcataaatgtcattggagaggccattgatgaaaggggtgatataaaaacggaacattatctcccgattcaccgtgaagctccatcttttgttgaacaagcaactgagcaac

SEQ ID NO: 1766 - DNA, 1158 bp, Artificial
  Synthetic
cggacgcgtgggctacacctcacctttctctctctatagaccaaacctaacctcaccatgtcttctcggaggcttctagcctctctcctccgatcaaccgcccaacgcggtggcgctatttccagatcgccattagcaaattccattcccagaactacttcacgcgcctcaccgaaaggattcctcttaaaccgtgccgttaagtacgctacctcagctgctgctgaaaagccgaaggcgactcctcctaaaccttccggtaatgaacctactggaaaaatcaccgatgaattcaccggcgcgggttcgatcgggaaagtgtgtcaggttattggtgccgtcgtagatgtgagattcgacgaaggtttgcctccgatccttacagcgcttgaggttttggataaccagatccggcttgtgcttgaggttgctcagcatttgggtgagaatatggttaggactattgctatggatggtactgaaggtcttgttcgtggtcaacgcgtcctcaatactggttctcctatcactgtccctgttggtagggccaccctcggtcgtattattaatgtcattggagagcctattgatgagagaggcgacattaacaccgatcactttttgccaattcaccgtgaagctcctgcctttgttgaacaggcaactgaacaacaaattctcgttactggtatcaaggttgttgatcttcttgccccttaccaaaggggaggaaagattgggctttttggtggtgctggtgttggaaagactgtgcttattatggaactgattaacaacgttgcaaaagcgcacggtggtttctctgtctttgctggtgttggtgaacgcactcgtgagggtaatgatttgtacagggaaatgattgaaagtggtgtcattaagcttggtgacaagcaaagtgaaagcaagtgcgctcttgtgtacggtcaaatgaatgagccccctggtgctcgtgcccgtgttggtcttacaggcttgactgtggctgagcacttcagagatgctgaggggcaggatgtgcttctcttcattgacaacattttcagatttacccaggctaactcagaggtgtctgctttgcttggtcgtatcccatctgctgtcggttatcaaccaactttggctacagatcttgga

SEQ ID NO: 1767 - DNA, 616 bp, Artificial
  Synthetic
tgttattaggcctaaacctaccctctgttcttttcaggtaacttagcggtttcttttccctgtgtttggtgttcgtagtcaaatctggctatggctggtaatggcgtagtggccatctatggcaatagtagctccatcgcagaccccaagaagtcctcctatggtgtcaaggtcggccttgcccaaatgctccgcggtggtgtcatcatggacgtcattaacgttgaacaggcccgtatcgccgaagaagctggtgccgtcgctgtcatggcccttgagcgcgtccctgctgatatccgtgctgaaggcggcgtcgcccgtatgagtgaccctggcttgatcaaggagatcaaggctgccgtcactatccctgtcatggccaaggcccgcatcggccactttgttgaggcccagatcctcgaggccatcggtgttgactacattgatgagagcgaggtcctcacgccggccgacgatgctcatcacgtcaacaagcacaacttccgtgtcccgtttgtctgtggctgccgggacctcggcgaagcactccgccgcattgcggagggcgctgccatgatccgcaccaagggggaagccggcactggcgacatcgttg

SEQ ID NO: 1768 - DNA, 963 bp, Artificial
  Synthetic
tgtttagtttgcatagcccaatcataaggagcagcaattttctttgcatatgacaacacctcatcatcatccatattacgcaaaagcctaatatcacccatgacagacctcacatgcttaacagcttcaacaacattaccagttccagcttcaccttttgttcgaatcatggccgcaccttcccgaatcctccttaggacttccccaagattacgacaaccacaaacaaatggaatcctgaaattatgcttgttaatatgatgttcttcatcagcaagggtcaaaacctcactctcatcgatataatcaacaccaatcgcttcaagaatctgagcttcaacgaaatgaccaattcgagctttagccatgacaggaatagtaacagtatatggaaatggagcaataacagaggcaaaaacctcaccattctctgttaaagtaggattagcacagatgcttagaggaggagtaatcatggatgttgttaatgcagaacaagccagaatcgctgaagaagcaggtgcttgtgctgtcatggcattagaacgtgtaccagcagatattcgtgctcaaggtggtgttgctcgtatgagtgatccacagatgattaaagaaatcaaacaggctgttactattcctgtcatggctaaagctcggattggtcattttgttgaagctcagattctcgaagcaattggtgttgattatatcgatgagagtgaggttttgacccttgctgatgaagaacatcatattaacaagcataatttcaggattccatttgtttgtggttgtcgtaatcttggtgaagccctaaggaggattcgggaaggtgcggctatgattcgaacaaagggtgaagctggaactggtaatgttgttgaagctgttaggcatgtgaggtctgtcatgggtgatatgaggcttgtgcgtaatatggatgatgatgaggtgtgttcatat

SEQ ID NO: 1769 - DNA, 647 bp, Artificial
  Synthetic
ttccattgctttaatcaggatcgcggaggcggaggaagaaagagtagcggcgatggatgccaacggcgtggtggccgtgtacggcaacggcgccatagcggagcccaagaaggcgtcatacgcggtcaaggtcggtctcgcccagatgctccgcggcggcgtcatcatggacgtggtcaacgccgagcaggcccgcatcgccgaggaggccggcgcggtggcggtcatggccctggagcgcgtcccggcggacatccgcgcccagggtggcgtcgcacggatgagcgacccgggcatgatcaaggacatcaagaaggcggtcaccattccggtcatggcaaaagcccgcattgggcattttgtcgaggggcaggtgctcgagtccatcggcgtcgacttcgtggacgagtccgaggtgctcacccccgccgacgacgccaaccacatcaacaagcacaacttccacgtcccgttcgtgtgcggctgccgcaacctgggcgaggcgctgcggcggatcaccgagggcgcggtcatgatccggacccaagggcgcacgcggcaccgggaacgtgatcgaggcggtgcgccacgtccggtcgctcatgggggacatccggcggctgcgcagcctggacgaggacgaggtg

SEQ ID NO: 1770 - DNA, 100 bp, Artificial
  Synthetic
ctcaaataaaccactcaatcgattccttgataccccttgggacaaatctacttgttctctccaaacttacccctccaaataccatcatcaccatcaccat

SEQ ID NO: 1771 - DNA, 678 bp, Artificial
  Synthetic
agcaaccatttcgtcatcggaccatagcactccccaaatacctcactcttctcgctgatctggtcctgctcttatccctcattcccatcatcaacttttccacatctcgaacaaatatgtcgggagacggctatcgttcagtcgcctatttcgtcaactgggccatctatgctagaaagcatcgcccccaagatctccccgttgataaactcactcatatcctctatgcctttgccaatgtccgccaagatagcggggaagtacacatgacggatggctgggcggacacagacatccattgggagggcgactcatggaacgacacgggaaacaacatgtatggatgcctcaagcagctgaatcttctcaagaagcgcaaccgcaatctcaaggttttgctgtccattggaggttggacgtacagcggcaacttcaagggccccgccagcactcagcagggccgtgagacattcgccaaatctagtctcgagctgctcaaaaacttgggtttcgacggacttgatatcgattgggagtatccccagaatgcagacgaggctaggaatttcgtcgagcttctcgccaccgtccgcagagagctggatgcctattctgctacccttccaaactacagccactttgaactgactgttgcttgtcccgccggagctacgcact

SEQ ID NO: 1772 - DNA, 997 bp, Artificial
  Synthetic
ttgaacaatctaccaacatcacaagcaattcaccatgttgagcttcctcggaaaatcggtagccttgctggctgcgctgcaggctactctcagctctgcaagccccctagccacagaagagcgctctgttgagaagagagccaacggatacgcaaactccgtctatttcaccaactggggcatttacgaccgcaacttccagcctgccgatttggtggcatcagatgtcactcatgtcatctactcattcatgaacctccaggcagacggcacagttgtctctggcgatacctacgctgatttcgagaagcactatgccgatgattcttggaatgatgtcggcaccaatgcctacggctgtgtcaagcagctgttcaaggtcaaaaaggccaaccgaggcctcaaggttctgctctccatcggtggctggacctggtccaccaacttcccctctgcagcaagcacggatgccaaccgaaagaactttgcgaagactgccattaccttcatgaaggattggggtttcgatggcattgacgtcgattgggagtaccctgcagacgccacccaggcctccaacatggttcttctgctcaaggaagtccgatctcagctggatgcttatgctgcccagtatgcccctggctaccacttcctcctcaccattgccgcaccagctggcaaggataactactccaagctgcgcctggccgatcttggccaagttctcgactacatcaacctcatggcctacgactatgctggatccttcagccccctcaccggtcacgacgccaacctgtttgccaacccgtccaaccccaacgccacacccttcaacaccgattctgccgttcaggattatatcaacggaggtgttcccgccaacaagattgttctcggaatgcccatctacggacgatcattccagaacaccgctggtattggccagacttacaacggagttggaggtggcggtggtggctcaactggaagc

SEQ ID NO: 1773 - DNA, 448 bp, Artificial
  Synthetic
cccacgcgtccgccaatctcgaccattaccatcatacagccaacctctacataagcacaaataccattcaaaatgtcttacggcggtgacaacaacgacaactacggctctcgccgtaatgacgacaactttggctccggaggagattctttcggctctggtggaaaccagcaatatggctccggaggagactcatttggctctgggggagattcatacggctctggtggaaatcaattcggctccggcaaccgccgtaacgatgacagctcatttggtaccagtggccagggcgagttcggctctggaggtaactatggcagctctggcggtgactcctatgggtctggaggaaacacctatggctccggcggcaatgacaactttggctctgggggcaatgatacgtacggctcgtcccgtaaccaagagtcttcttttggatcca

SEQ ID NO: 1774 - DNA, 530 bp, Artificial
  Synthetic
gcgggattaggagttggagaagaggtgatacgagatgtcgtacgatgacgtggagatagaggacatggagtggaacgcggagctcgaagcgtacacctatccatgcccttgcggagacctcttccaaatctctctgcctgaccttcgcttgggagaggagatagccagatgccctagctgctccctctacatcaccgttgtctacaacctcgaagacttccaagaccctcggcccccgcctcgcccccaacagccgatcgccgtcgcctgatctttccagttgcttcgttcagtaaactcgacatctacattctatcctaaattgatagtcaccaaatgtctggtgcacttgagactgtttatctgacaagatttcatgtatcttggagttttgcttaaatcagcatgtagaatgataactgttggcttcttgatgtttcaaaggttagatattgtcatatctcgtgtgagttttttaaatttttggtcatgctagataccatgataatatattatgcaaggactatatg

SEQ ID NO: 1775 - DNA, 549 bp, Artificial
  Synthetic
  misc_feature (347)..(347): The residue at this position can be any nucleotide.
  misc_feature (450)..(450): The residue at this position can be any nucleotide.
gcaacacacacaatgtccttcaacttcaacgattctctcaacagtctgtccaccaccttctccccatgggccaagcgaacccagcgaatggtccaggagaagctcggcaacgtggaggacgtgaccgagctcccccaggagtacctggagctggaggctcgagttgacgctctcaagattgtccaccagaagctgctcgccgtcacctctaactacgaaaacgagggctacgactaccctcccaacctgcgggagtccctgtctgacctgtctaagaccatcaccgagaaggtgcagggtctgtcccaggtgtcttctgctgccgaggcccagtctgtgctcaccanccccggctccaagaaggaccccaagaccatgaaccatgctcttggccgagctgctcttggtggtgttgctgccctcaaggaggccggtgccgactctgacgancccctgtccgagtctctccagaagtacgccattgccgaggagaagattggtgagggccgactgtcccaggaatacctgatcgccaacaagttcaacgcc

SEQ ID NO: 1776 - DNA, 465 bp, Artificial
  Synthetic
acgcgtcgcacaaatcagctcgaatccatcaccatggcagacatcacagaagaaccccaggccctccctgtcgatgagacgcccatctcttccgtcaagaccaactccgctcgcaagaactctctttccaactacctcaagcaccgacccgaacgctccgagctggtagagaagaacattctcccagactctacagccgcacccggcctcctcgctcagcaaaaagagcttcagaaacacatgctcggagacaagctcaacgacaagatttcacatcgtccctcccccgacgccctcctcaaggaaggtgtcttacacgaagacccccgctccccagaggaaaagtacgccgaggccatcgaggaggagtacgctaagcgggagggcggcgcttaagcagcattagagctacatggcgaacacggatgctgggaaatgcgaacttgttttttctttttttttttt

SEQ ID NO: 1777 - DNA, 905 bp, Artificial
  Synthetic
aagtaacttaaatacccattctcaccactaaacatggttgtgcagaagatggaggataaaaatgctagaagaaacaaatataaagtaacacaactcaaaaactagcaaaattacagcctgaacaaggctcaagccaacatagaaagttccttgttgcattgaacttaaattttgttgaaggcaacaatatcacagctctgcacatattcattgataggctctactgttaatttttcctcaacgagagtgtccacagagacaaggtcatccacgatggtaagcatgatctgcaatttcttaatcccgtagccaactgggaccaatttggatgctccccaagtaagcccttcttgctgaacactgcgaacagcctcctccagcagcttcatatcagtttcatcatcccaaggcttaacgtccaaaagaatggatgactttccactctctttcttcttggtagatgctttagtagcctcccttgcttctgctgccttcttttcctcctctgtctcttctccgaagagatcaatatcatcatcgtcatcatcatctgcagccttagcagcttctttagctggagcagcttcagcaggagcagcttggcttccaattctcacaccgacagctttcccaggaaaacttgaggcaagttttgcagaaacagcttggtaccactggctagcattggggtaaagatctgaactgggttgctccaaaactgccccataaaccttaatatcgtccttcgtcaattgatctccggaaataaaagttcttccggaaagatggtcgttaacggagttgagaccagattcagtgtggagatctgagaaggttacagccattgttgaagagtaaaaaggagttgagatttgagagtgtgaagagagagtatgagcgacgcg

SEQ ID NO: 1778 - DNA, 952 bp, Artificial
  Synthetic
tttctctcttcagtcttctgtcatcgccagatcgtgaaagacttgtattattatcaagcaatggctgttgcattcaacaaccttaactctgattctggtctcaagaagcttgatgagtacctcctgactcgtagttacatctccgggtaccaagcctcgaaggatgatatcactgtgtattcatatctagcaaaatccccatcagctgaatatgtgaatgcatctaggtggtataagcacatcgatgcacttttaagaatctctggtgtatctggcgaaggtgccggtgtcactgtagagggatctgtaccaatcaccgaggaggcagtggcaactcctcctgctgctgacactaaagcctcagctgctgaagaagaagaagaagatgatgatgacgtagacctatttggtgaggaaactgaagaggagaagaaggctgctgaagaacgtgcagcagcagttaaggcttcagggaagaagaaagagtctggcaagtcctcagttctcttggatgtcaagccatgggatgatgagactgatatgaagaagcttgaagaagctgttcgaagtgttcagatggaaggattgacttatggagcatctaaacttgttcctgttggatacggtattaagaagctgcaaatcatgcttaccattgtggatgacttggtctctgtggatgatcttgttgagaattattttacggttgaacctatcaatgagtatgttcagagctgtgatattgttgctttcaacaaaatataaattctgttactctgaagttttgattgaaatgggtggctaaactgaagaacaacaaccagggttcgatgttgcttctctttatgttgttactatgttttcttgtcaaaagaggtgtacctgaacctgaacctgacaagggcatatgttttgctcgtttggattaatatttaaaattctggaatacttc

SEQ ID NO: 1779 - DNA, 597 bp, Artificial
  Synthetic
caagcctccaacgatgacttggctgtgtactctggattttcaactgcgccctcttcaagctataccaatgttgctaggtggtttactcacattgatgcactcctacgtctgagtggagttactgctgatggtcaaggcgtaaaggtcgagtcgacagctgttccttcagcttcaacccctgatgttgctgatgcaaaggctcctgcagctgatgatgacgatgatgacgatgttgacctttttggtgaggagactgaagaggagaagaaggctgctgaggagcgtgctgctgctgtcaaggcttctggcaagaagaaggaatctgggaagtcctcagtgttgcttgatgtcaaaccatgggacgatgagactgacatgaccaaattggaagaagctgtgaggaatgttaagatggaaggcctcctttggggcgcatccaagcttgtcccggttggttacggtatcaagaaattgcaaatcatgatgaccattgtcgatgatcttgtgtcagttgatagtctgattgaggactacttctacaccgaaccagcgaatgagtacatccagagctgcgacattgttgcgttcaacaagatc

SEQ ID NO: 1780 - DNA, 685 bp, Artificial
  Synthetic
  misc_feature (126)..(126): The residue at this position can be any nucleotide.
  misc_feature (589)..(589): The residue at this position can be any nucleotide.
ggcttttgcgaggcggcagagctatggcgatcagcttcgacgatcttgattccgccggcgggctcaagagcctcgatgagtacctcgtcaagcgcagctacatctctggctcccaggcatccaggnacgatttgcttgtctacatggccttggctggagctccgtctcaggatctcatcaacttgtcgcgctggtactcgcacatttctggattgatccactccagcttccctggatctccagttggtgtgtcgctgaaggatggcactactccacttccggctgccccggctgctccagctacaccaccacctccgcagaccccggctgccgcaaaggatgacgatctcgatctgtttggagaggagacagaggaagagcaagccgccgctgcagagagggaggctcaaaagaaagcgtcggccaagaagaaagaatctgggaagtcgtctgtgctaatggacgtgaagccgtgggacgatgagaccgacatggtgaagctcgaggcggcagtgagggccgtgcaaatgccggggctcttctggggtgcttccaagctgacccctgtgggatacgggatcaagaagtngacgatcatgatgacggtggaggacgagcttgtgtctgtcgattctttgattgaggatcatctcacggaaggtccggcagcggagttcatccagag

SEQ ID NO: 1781 - DNA, 150 bp, Artificial
  Synthetic
gttctctcttcagtcttctgtcatcgccagatcgtgaaagacttgtattattatcaagcaatggctgttgcattccagaacctcaactctgattctggtctcaaaaagcttgatgagtacctcttgacctgcagttacatctccgggtac

SEQ ID NO: 1782 - DNA, 374 bp, Artificial
  Synthetic
gcagaggagagggatgctgctaagaaggacaccaagaagcctaaagagagtggaaagtcttctgtgctcatggatgttaagccatgggatgatgaaaccgacatgaagaaactggaagaggctgttcgtggtgttgagatgcctggtcttttctggggagcctcaaaacttgtaccagttggttatgggatcaagaaactcacaattatgttcacgattgttgatgacctcgtgtccccggacaacctcattgaagacttcctcacctcagagcctaacaacgagtacatccagagttgtgacattgtcgctttcaacaagatttagagacttcaaatttctccttaccgaaacatatctgaatttcaagtttt

SEQ ID NO: 1783 - DNA, 392 bp, Artificial
  Synthetic
ctacaaaaacttgggaaactgaatatagaagaagaagaagaaccagaccacatgaacacagacattccttgaagctttctccatcctcatatcttgttgaaggcaacaatgtcacagctctggacatattcattgatcggttcaacagtgagttgctcttcgatcatggtgtcaatagagacaaggtcgtcaacaatggtgcacaaaatctgcaacttcttgataccataaccaactgggacaagctttgatgctccccaaaacaaacctttcatctgaatggacttcacagcttcctcaagcttcttcatgtcagtctcatcatcccacggtttgatatcaatcaaaactgaggactttccagattccttcttctttgtaaatgccttgac

SEQ ID NO: 1784 - DNA, 577 bp, Artificial
  Synthetic
gcagctgattctaaggatgctgcggctgatgaagaagatgatgatgatgttgaccttttcggagaggagaccgaagaggaaaagaaagctgctgaagagagagcagcttctgtcaaggcatctacaaagaagaaggaatctggaaagtcctcagttttgattgatatcaaaccgtgggatgatgagactgacatgaagaagcttgaggaagctgtgaagtccattcagatggaaggtttgttttggggagcatcaaagcttgtcccagttggttatggtatcaagaagttgcagattttgtgcaccattgttgacgaccttgtctctattgacaccatgatcgaagagcaactcactgttgaaccgatcaatgaatatgtccagagctgtgacattgttgccttcaacaagatatgaggatggagaaagcttcaaggaatgtctgtgttcatgtggtctggttcttcttcttcttctatattcagtttcccaagtttttgtagactgttgttttgactctgttatggcctgccatctctgatccattttgatatttaatgaaaagtgacaattcagt

SEQ ID NO: 1785 - DNA, 690 bp, Artificial
  Synthetic
ggcttctctgatctttcttccgctgctggtctcacccagctgaacgagttcctcgtcgacaagagctacattgagggcaacgctgcctctcaggctgacgtggctgtctacaaggccgttgcttctgcccctgacgccgagaagtaccccaacgccgcccgatggttcaagcacattgctgcccaggaggaccactctgctctccccggtaccgccaaggaggcctctgcttacggccccgagggtgccgccgccgccgctgaggaggaggacgacgatgatgtcgaccttttcggctccgacgatgatgaggtcgatgaggaggctgagaagctcaagcagcagcgactcgccgagtacgccgccaagaaggccgctaagcccaagaccgccgccaagtccattgtcacccttgacgtcaagccttgggatgacgagactgatctcgatgctctccttgagaacgtcaagaaggtcgagatggagggtctggtctggggtgcccaccagtggatccccgttggtttcggtatcaagaagctccagatcaacctcgttgttgaggatgaccttgtttctctcgacgagctccagcagctcattgaggaggacgaggacaacgtccagtccactgatatcgctgccatgcagaagctttaagtgtttctagcttatatatatggtaaaacg

SEQ ID NO: 1786 - DNA, 726 bp, Artificial
  Synthetic
ccgcgaagaagccctaactcttagaaaatcaggacgctttcggagaagggcaagggagcgtcctcatctgtgatctctttgacccggcaatggcctgtttcggtgatctcagctccccctctggcctcaaccagctcgatcagttccttctcactcgtagctacatcactggataccaagcctcaaaggatgacattgtaacatatcttgctatcaaaggaactccgagtgctgacttgatcaacgcatctcgttggtacaagcacatcactgcccttctggaaaaaagtttcccagggactcctacaggtgtgacagttgagtcatctgtggaggtaccatcatctgtaagtagagagttgcctgttcctcccaagacacctgctccacctactgaaaaaccagctgaggcggaagatgatgatgatcttgacctcttcggggatgagaccgaagaagaaaagcaggctgcagcagagcgtgaggagaaagtaaaggcatcatcaaagaaaaaagaaagtgggaaatcttccgtcttgatggatgtgaagccatgggatgatgaaacagatatggttgagcttgaaaaagctgttagaagtgtctcaatgccagggcttcactggggtgcatcaaaattggcaccggttggttatggcatcaagaagcttcagattatgatgaccattgaagatgacctagtttctgttgataatctaattgagg

SEQ ID NO: 1787 - DNA, 507 bp, Artificial
  Synthetic
aggtggacaggaagtagaatttattggtgagtattaagaggggggcagcacattggaagccctcatgagtgcagggcccgccacttgtccagagggccacgactggggatgtacttgaccccacagccatctgggatgagccgcttttcagccaccatgtcttcaaattcatcagcattgaacttggtgaagccccacttctttgagatgtggatcttctggcggccaggaaacttgaacttggccctgcgcagggcctcaatcacatgctccttgttctgcagcttggtgcggatggacatgataacttggccaatgtgaaccctggccacagtgccctggggctttccaaaggcacctcgcatgcctgtttggagcctgtcagccccagcacaggacaacatcttgttgatgcggatgacgtggaaggggtggagccgcacccggatatggaagccatctttgccacaactttttaccatgtacttattggcacaaattcgggca

SEQ ID NO: 1788 - DNA, 663 bp, Artificial
  Synthetic
aatcaaaaatggctcgacgacccgctaagtgttaccgataccagaagaacaagcccttccccaagtctcgatacaaccgagccgtgcccgaccccaagatccgaatctacgatcttggtcgaaagcgagcccacgtcgacgacttccctctgtgtatccatctcgtttccaacgagcgagagcagctgtcttccgaggctcttgaggctgcccgaatctgtgccaacaagtacatcaccaaggtgtccggacgagaggccttccacatgcgaatccgagcccaccccttccacgttctgcgaatcaacaaggtgctttcttgcgctggtgccgatcgacttgctcagggtatgcgaggagcctggggtaagcccgccggtcttgctgcccgagttgacattggccaggttctgatttccatccgaaccaaggacaacaacaaggccaccgttatcgagggtctgcgacgatgccgatacaagttccccggtcagcagaagatcatcatctccaagaagtggggtttcaccaacctcgaccgagaggagtacatgacccgacgacagaacggagagatcaaggaggacggtgcctacgtcaagttcctcaccaagaagggtcctctggccgagtctcttgccgagttccccgactacaacggtg

SEQ ID NO: 1789 - DNA, 718 bp, Artificial
  Synthetic
ggccggcgagatgctaccgccagatcaagaacaagccgtacccgaaatctcgcttctgccgcggtgttccagaccctaagatcaggatctacgatgtgggcatgaagaagaagggcgtggacgagttcccctactgcgtccatctggtgagctgggagaaggagaatgtctcgagcgaagcccttgaggcggctcgaatcgcctgcaacaagtacatggcaaagtacgccggcaaggacgcgttccatctccgagttcgtgtgcaccccttccatgtcctgcggatcaacaagatgctttcgtgcgctggcgctgatcggctccaaactggaatgaggggagctttcggcaagccgcagggaacttgcgcccgtgttgacatcggccaggtgctgctctcggtccggtgcaaggacaacaacggagttcacgcgcaggaagcgttgaggagggcgaagttcaagttccccggcaggcagaagatcatcgtcagccggaagtggggatttacgaagttctctcgcaccgacttcctcaagttcaaggcggagagcaggatcgtcaacgatggcgtgaacgcgaagctcctgacttgccacggaccactctcgtctcgatccgcggaaaccgctatacttccggatgatgaagtagtagcgtaagataagaaaaagaaaaccaattgtactacgtttattaatcgaaacgatgttttgtt

SEQ ID NO: 1790 - DNA, 600 bp, Artificial
  Synthetic
cccccgagccgcacatccccgcctcttcccgccgccgtccgccgcgcgcacgccgccgccgccatggggaggagacctgcaaggtgctatcgccagatcaagaacaagccgtaccccaagtcaaggtactgccgtggtgtccctgaccccaagatcaggatctacgatgtcgggatgaagaagaagggtgtggatgagttctcccactgtgtgcatctcgtctcttgggagaaggagaatgtcaccagtgaggctcttgaggctgcgcgtatcgcgtgcaacaagtacatgaccaagtctgcaggaaaggatgccttccacctcagggttcgggttcacccgttccatgtgctccgtatcaacaagatgctttcgtgtgccggggcagataggctccagactggaatgaggggtgcttttgggaagccacagggaacctgtgctagggtggatattggccaggtcctcctttctgtgcggtgcaagcccaacaatgctgtccatgccagcgaagccctccgtcgtgccaagttcaagttccctggtcgccaaaagatcattgagagtagaaagtggggtttcaccaagttcagccgcgat

SEQ ID NO: 1791 - DNA, 766 bp, Artificial
  Synthetic
gatgtttaaatctactgtatttaccttcgcattaattaagcatggggagaaggcctgctaggtgctaccgccagatcaagaacaagccgtaccccaagtcaaggtactgccgtggtgtccctgaccccaagatcaggatctatgatgttggcatgaagaagaagggcgtggatgagttcccctactgtgtgcacttggtgagttgggagaaggagaatgtctccagtgaagctcttgaggctgcccgcattgcttgcaacaagtacatgaccaagaatgcaggaaaggatgccttccacctaagggtcagggtccacccgttccatgtccttcgtatcaacaagatgctctcgtgtgctggggctgataggctccaaactggaatgaggggtgcttttgggaagcctcagggtacctgtgctcgcgtggacattggtcaggttcttctttctgttcgttgcaaggagagcaatgctaaacatgctgaagaggcactccgccgtgccaagttcaagttccctggccggcaaaagatcatccacagcaggaagtggggcttcaccaagttcacccgtgaggagtacgtcaagttgaaggctgagggcagaattatgtctgatggtgtcaatgctcagctgcttggttctcatggtcgtcttgcgaagcgtgcccctgggaaggcgtttctggctgagaccattcaacgttccgccgcggccgcttatccgtatgatgttccggattatgccgagctctacaaacagct

SEQ ID NO: 1792 - DNA, 554 bp, Artificial
  Synthetic
gaattcacaggcagattaagaacaagccatacccagaatccaggtactgtcgtggtgtacctgacccaaagattagaatttatgatgttgggatgaaaagaaaaggagttgatgaattccccttctgtgtccacttggtgagttgggagaaggaaaatgtctcaagtgaggctttggaagctgcacgtattgcctgcaacaagtacatgaccaagtttgctgggaaggatgccttccatttgagagtcagggtacatcctttccacgtcttgcgtatcaacaagatgctttcatgtgctggagctgatagactccagactggtatgagaggagcatttggtaagcccctaggtacttgtgccagagttagcattggtcaggtcctcttgtcagttcgttgcaaggataccaacggcaacaacgcccaggaagcccttcgtcgtgccaagttcaagttccctggacgtcaaaagatcattgtcagcaggaagtggggattcacaaagttcagccgtactgactacgtcaaatggaagtcagagaacagaatcgtt

SEQ ID NO: 1793 - DNA, 689 bp, Artificial
  Synthetic
gggaggaggaagggggggggagaggggtagggttgagcactaggacacctccgccatgggccgaagaccagcaagatgctaccgccaaatcaagaacaaaccatatcctaagtctaggttttgccggggtgttcctgacccgaagattcgtatctttgatgttgggatgaagaagaaaggagtcgacgagcttcctttctgtgtgcatcttgtaagttgggagaaagagaatgtttctagcgaggcccttgaggcagcccggattgcttgcaacaaatacatgactaagtctgccgggaaggataccttccacctccgcgtccgagtccacccgttccacgtgctccgcatcaacaagatgctttcatgtgccggtgctgataggttgcagacaggaatgaggggggcatttggaaagccgctgggtacctgtgcccgtgtggccattggccaggttcttctctctgtgcgatgcaaggataatcactccgctcaggcacaggaagccctcaggcgagccaagttcaaattccctggaaggcaaaagatcattgttagcaggaaatggggctttacaaagttctcaagaactgactatctgaaatggaggtctgaaggtagaattatgcatgatggtgtcaatgctaagttgctgggatgtcatggacctctctccaatcgctcatctg

SEQ ID NO: 1794 - DNA, 721 bp, Artificial
  Synthetic
agcaggagaaggaatagactagtcttctgcgattttagccatgggccgccgaccagcaagatgttaccgtcaaatcaagaacaagccctatccaaagtctaggttttgccgaggtgttccggatccaaagatccgtatcttcgatgtggggatgaagaggaaaggtgtggatgagctgcctttctgtgtgcatttggtgagttgggagaaggagaatgtgtcaagtgaggcactggaggcagctcggattgcctgtaacaagtacatgaccaagtatgccgggaaagataccttccacctccgtgtcagagtccaccccttccatgtcctccgtatcaacaagatgctctcgtgtgctggagctgataggcttcagactgggatgagaggagcctttggaaaacctctgggtacctgtgcccgggtggcgattgggcaggtccttctttctgtgcggtgcaaggacaatcactcagcccaggctcaggaagccttgcgtagagccaaattcaaattcccaggaaggcaaaagatcattgtcagcaggaaatggggattcactaagtattccagaaccgattacctgaaatggaaaactgaaggtagaatggtgcatgatggcgtgaatgccaagcttctgggatgccatggtcctctgtcaaagcggaaccctgggcaagctttcctttctgctgcagttgctgcttcttaaggctgagct

SEQ ID NO: 1795 - DNA, 843 bp, Artificial
  Synthetic
gaagccgcagactaatcgcagagagaattagccatggggagaaggcctgcaagatgttatcgccagattaagaacaaaccttatccaaaatcacggttttgccgtggtgtgccagatccaaagatcaggatctatgatgtgggtatgaagaaaaagggagttgatgaatttcctttctgtgtgcacttggtcagttgggagaaggagaatgtttcaagtgaggcacttgaagctgctcgtattgcgtgcaacaagtacatgaccaagtccgctggaaaggatgctttccacctcagggttagggtccatcccttccatgttttgcgaattaacaagatgttgtcatgtgctggggctgataggctccaaactggtatgaggggagcttttggtaaaccacagggagtctgtgctcgtgttgctattggtcaggttcttctctctgttcgctgcaaggatggtaatgctaaccatgcccaagaggcactgcgccgtgctaagtttaagttccccggccgacaaaagatcatcgtcagcaggaagtgggggttcactaagttcagccgtactgattatctgaaatacaagtcagataatcgtattattccagatggtgtcaatgccaagcttctcggttgtcatggccgacttgctgcacgtcaacctggaagagcttttttggaagcagtggggaattgaagttgcgaacttaccaaactgaacctttagttgtctacttctgttgaatgaaattttgtgtcctgatcatcgatctacttttgaactattacttgagttactgctttgaacattttagtttactggtaaagcccggcttgtttt

SEQ ID NO: 1796 - DNA, 691 bp, Artificial
  Synthetic
gaggacgcaagcggaaccaaggccttactcgaattgtagcagagatggccgtcgggaagaacaagcgcatctccaaaggcaagaagggagggaagaagaaagtggtagatcccttctcgaagaaagattggtacgatatcaaggctccttcagtctttaccattcgcactgtcggaaagactcttgtcaccaggacacagggtacaaagattgctgcggatggcttgaaaggacgtgtttttgaggtatctcttgcagacctccaaaaagatgaagatcaagctgcaaggaagatgaaactaagagccgaagatgtgcaaggaagaaacgttctcactaatttttggggcatggatttcaccacggataaactgcggtctcttgtgaggaagtggcaatccctgatcgaggctcatgttgatgtgaagactactgacaactacacactccggatgttttgtatcgctttcaccaagaagcgcccaaaccaaatcaagaagacttgctatgctcagtcaagtcagatccggcagatccggaagaagatgactgagataatggtacgagaagcacagtcctgtgatctgaaagagctttgtggcgaagctcattccagaagtgattggcaaggagattgagaaagctactgctggaatctatcccttgcagaacactttcattaggaaagtta

SEQ ID NO: 1797 - DNA, 802 bp, Artificial
  Synthetic
agggcgtcgtcgtcggagctcagttgcgatggccgtcgggaagaataagcgcatttccaagggaaagaagggtggcaagaagaaagtggttgatcctttttcaaagaaagattggtatgatatcaaggctccatcagtcttcactattaggacggtcggtaagacccttgttactcggacacagggtacaaagattgcagctgatggcctgaaggggcgtgtttttgaggtctctcttgcggacctccaaaaggatgaagatcaggctgctaggaagatcaagcttagggccgaagatgtgcaaggaaggaatgttctcaccaatttctgggggatgaacttcactaccgataaactccgctctcttgtaaggaaatggcagactcttattgaggcccatgttgatgtgaagacgacagataactacactttgagaatgttctgcatcgccttcaccaagaagcgcccgaatcagatcaagaaaacttgctacgcacagtcaagccagatccgacagatccggaagaaaatgacagagatcatggtgaaagaagccgcgtcatgtgacttgaaagagcttgttgcaaagttcatcccggaagtaattgggaaggaaatagagaaagcaactgctggaatctaccccctgcagaacacttttatcaggaaggtcaagatcctcaaggcacccaagtttgatctaggaaagctcatggaggtgcatggagactacagtgaagatgtgggaactacagtagagaggccggtcggcgacgaagcagagacaactgatgccggaact

SEQ ID NO: 1798 - DNA, 614 bp, Artificial
  Synthetic
aaaataagcagactaccactactaatctacagcttcttgacattccgcaaacatggcggttggcaagaacaagagattgtccaagggcaagaagggcctgaagaagaggaccgatcccttcgctaagaaggactggtactccgtcaaggcaccctccactttcgccgtcagagatgtcggcaagaccctcgtcaaccgtaccaccggtctgaagaacgccaacgactctctcaagggccgtgtcttcgaggcttccctcgccgatctccagaaggatgaggaccacagcttccgcaagatcaagctgcgcgtcgatgaggtccagggcaagaactgcttgaccaacttctacggtctcgacttcacccacgacaagctcgcctccctcgtccgcaagtggcaatctctcatcgaggccaacgttgtcgtcaagaccaccgacgactacctcctccgcctcttcgccattgccttcaccaagaggcgccccaaccagatcaagaagaccacctacgccaggtcttcccagatccgcgccatccgcaagaagatgaccgacatcatggctcgtgaggcctccagctgcactctcagccagctcaccaccaagctca

SEQ ID NO: 1799 - DNA, 690 bp, Artificial
  Synthetic
aagccctagccgcttctaggtttttagggttcttctcagccggctgtgcgccatggcggtcgggaagaacaagcggatgtccaaggggaagaagggaggcaagaagaagatcgtcgatcccttctcgaagaaggactggtacgatgtgaaggcgccgtccaccttcaacgttcgccaggtcgggaagacactggtgacgagaacacaggggactaagattgcctctgatggtcttaaaggccgtgttttcgaagtgtcattggctgatctgcaaaacaacgacgaggaccatgccttccgcaagatcaagctcagggccgaggatgtccagggacgcaacgtccttaccaacttctggggaatggacttcacgacggacaagctccggtccctcgtccgcaagtggcagtcgctcatcgaagctcacgtcgatgtgaagacgactgacaactacaccttgaggctcttctgcattgggttcaccaagcgcaggcccaaccaggtgaagcggacgtgctatgcgcagtcgagccagatccgccagatccggaagaagatgagggagatcatggtccgcgaagctcagtcgtgcgacctcaaggacctggtggcgaaattcatcccggaggtgatcgggaaggagatcgagaaggtgactgctggaatctatcccctgcagaacacatacat

SEQ ID NO: 1800 - DNA, 684 bp, Artificial
  Synthetic
ttcaacaccgttcgacattaagacgtgattaaacaccatggctcagggaaagaacaagcgactctctaagggaaagaagggtatcaagaagcgagttgtcgaccccttcaccaagaaggactggtacaacatcaaggctccctccacctttgagaaccgagacgtcggcaagaccctcgtgaaccgatccaccggtctgcgactcgccaacgactacctcaagggccgagtgctcgaggtgtcccttgctgatctgcagggccaggaggaccactccttcaagaaggtcaagctgcgagttgacgaggtccagggcaagaacctgctcaccaacttccacggctttgacttcacttccgacaagctgcgatctctcgtccgaaagtggcagactctgattgaggctaacgtcaccgtcaagacctccgacgactacttcctccgactcttcgtcatcggtttcaccaagcgacaggccaaccaggtcaagaagaccacctacgcccagacctctcagatcaaccagatccgaaagaagatgaccgacattgttgtccgagaggcttccaacgtgactcttgctcagctcaccgccaagctcatccccgaggttattggccgagagattgagaaggccactcagaacatctaccctctgcagaacgtctacatccgaaaggtcaa

SEQ ID NO: 1801 - DNA, 681 bp, Artificial
  Synthetic
ccccccgttttctcctcgccgcttccacctctctcgcgccgccgccgccgccgagcgcctggagcagcgtcagccatggccgtaggtaagaacaagcgcatctccaaggggaagaagggatccaagaagaagaccgtcgatccctttgctaagaaggactggtatgatatcaaggccccgtcggtgttcaatgtgcggaacatcggcaagaccctcgtgtccaggacacagggtacaaagattgcttctgagggcctaaagcatagagtgtttgaggtctccttagctgatctccagaacgatgaggatcaggcgtacaggaagatcagacttcgtgctgaggatgtgcaagggaagaacgtgctcaccaacttttggggcatgtcgtttactaccgataagctcagatcacttgttaagaagtggcagacactgattgaggctcatgtggatgtcaaaaccacagacggctacatgctgcgtctgttctgtatcggcttcaccaagcggcggcctaaccaggtgaagaggacttgctatgctcaagcgagtcagatcagacagattcgtcgcaagatggttgaaatcatggccaaccaggcttcaagctgtgatttgaaagagctagtttcaaagttcattcctgaagttattgggaaggaaattgagaaggcgacatcc

SEQ ID NO: 1802 - DNA, 684 bp, Artificial
  Synthetic
gcagctcgtcttaagtatcgcctcatcatccccttccccaatacccccaaagcagttctaatctctccatcccaacatggccgtcggcaagaacaagaggatttccaagggaaagaagggaggaaagaagaaggcggcggatccgtatgcaaagaaggactggtatgacattaaggcaccatcagtttttgatataaaaaacgttggcaaaacacttgttactaggactcagggaactaagattgcttcagagggacttaagcatagagtttttgaagtgagtctggctgatcttcaaaaggatgaggatcaggctttcaggaagatcagattgagagcagaggatgtacaaggaaagaatgtcctcacaaacttctggggaatggattttacaactgacaagttgaggtcacttgttcgcaaatggcagactttgattgaggcccatgtggatgttaaaactaccgacagctatactctgaggatgttctgcattgcttttacaaagaagcgtccaaaccagcagaagcgtacctgttatgctcagagcagccagatccgtcagatccgtaggaagatggttgagatcatgagaaaccaagcaagttcatgtgacctgaaggagttggttgctaaattcatccctgaatcaattggcagagagattgagaaagcaacttcaag

SEQ ID NO: 1803 - DNA, 321 bp, Artificial
  Synthetic
cccacgcgtccggcttcttcttcttcctcactgtagctcgtcggcgctacaccatctagaagacccttaaccatggctgtcgggaagaacaagaggatttcaaagggtaggaaaggaggaaagaagaaggctgttgatcccttctccaagaaggattggtatgacgtgaaggctcctggttctttcacgaacaggaatgttgggaagactcttgtttccaggactcagggtaccaagattgcctctgagggactgaaacacagggtgtttgaggattctcttgctgatctacaaaatgatgaggataatgcctacaggaag

SEQ ID NO: 1804 - DNA, 669 bp, Artificial
  Synthetic
gcgccgccgccactcactggccaaaccctaaccccggaggagagggaggagcagccatggccgtgggcaagaacaagaggatctccaagggcaggaagggcagcaagaagaagaccgtcgatcccttttccaagaaggattggtacgacatcaaggcgccgaccgtgttctccgtccgcaacatcggcaagaccctcgtctccaggacccaggggaccaagattgcatctgagggtctcaagcatcgtgtctttgaagtctccttggcggatcttcagaatgacgaggatcaggcttacaggaaggttagacttcgtgctgaggatgttcaggggaggaatgtcctcacgaatttctggggcatgagttttaccacggacaagcttaggtccttggtcaagaaatggcaaacattgattgaagcccatgtggatgttaagaccacagataactacatgctccgcctgttttgcattggtttcaccaagcgccgcccaaatcaggtgaagcgtacctgttacgctcaggctagccagatccggcagatccgccggaagatggttgagatcatggccaaccaggcatcaacatgtgacttgaaagaactggtttcaaaattcatccctgaagtcattggaaaggagatcgagaagtcaacttcaagtatat

SEQ ID NO: 1805 - DNA, 949 bp, Artificial
  Synthetic
ctcctcgtccaaaagcagctgcaacatctccttcccaacatggctgtcggtaagaacaagaggatttcaaagggaaagaaaggaggaaaaaagaaggcggcggatccgtacgcaaagaaggactggtatgacataaaggcaccatcagtatttgatatcaaaaacgttggcaagaccctggtcactaggactcagggtactaagattgcttcggaaggactaaagcacagagtatttgaagtcagtttggctgatcttcagaaggatgaggatcaatccttcaggaagatccgcttgagggcagaagatgtgcaagggaagaatgtcctcacaaacttctggggaatggatttcacaacagacaagttgaggtctctggtaaagaagtggcagacattgattgaggctcatgtggatgtcaaaactacagatagctacactctccggatgttctgcattgcttttacaaagaaacgtcccaaccagcagaagcggacatgctatgctcagagcagccagatccgtcagatccgtcggaaaatggttgagatcatgagaaaccaagcaagttcctgtgacctgaaggagttggtcgcaaaatttatccccgagtcaattggcagagagattgagaaagcgacttcaagcatcttcccactgcaaaatgtttatatccgcaaagtgaaaatccttaaggccccaaaatttgatattggcaagctgatggaggttcatggtgactattcagaagatgttggcgtgaagttggatcgaccagctgatgagaatgttgctgaggcagaacccgaaattcctggagcttagacttgtttgatttggattctatctgaatatggtgcttgtcttctaaatttatgaatttcttttagttgaggtgttaaggcgcgacctatcaaaatattggatatctttctttggcattcatcag

SEQ ID NO: 1806 - DNA, 681 bp, Artificial
  Synthetic
acgcgtcgcatttttcgttctttttgcgtttctctctctctctcgctctctctttctgtttcctgtgaaaatgcagatctttgtgaagaccctgacggggaagaccatcaccctggaggtggaaagctccgacaccattgataacgtcaaggccaagatccaagacaaggagggcatcccccctgaccagcagcgcctcatctttgccgggaaacagcttgaagatggccgtacccttgcagactacaacatccagaaggagtccaccctccaccttgtcctccgcctccgaggtggtatgcaaatcttcgtcaaaaccctcaccggtaagaccatcaccctcgaagttgagagctctgacactatcgacaatgtcaaggccaagatccaagacaaggaagggattccccctgatcagcagaggcttatcttcgctgggaagcagctcgaagacgggcgaaccctcgctgactacaacatccaaaaggagtccaccctccacctcgtgctgaggctccggggaggcatgcagatctttgtcaaaaccctgacggggaagacaataacactggaggtggaaagctctgacacaattgacaacgttaaagctaagattcaagacaaggaagggatcccccccgatcagcagcgtttgatctttgccggcaagcagctggaaga

SEQ ID NO: 1807 - DNA, 659 bp, Artificial
  Synthetic
cacgcgtcgcccacgcgtcgctcttctcttgtggtatctctctctctctctctctctctctttcctgagaaaatgcagatcttgtgaagaccctgacagggaagaccatcaccctggaggtggaaagctccgacaccatcgacaacgtcaaggccaagatccaagacaaggagggcatcccccctgaccagcagcgcctcatcttcgctgggaaacagctcgaagatggccgtaccctcgctgactacaacatccagaaggagtccactctccaccttgtcctccgcctccgaggtggtatgcaaatctttgtcaaaaccctcactggtaagaccatcacccttgaagtcgagagctctgatactattgacaatgtcaaggccaagatccaagacaaggaggggattccccctgaccagcagaggctcatctttgctgggaagcagcttgaagatgggcggacccttgccgactacaacatccagaaggagtccaccctccaccttgtgctgaggctccgggggggcatgcagatcttcgtcaaaactctaacagggaagacgataacgctggaggtggaaagctctgacacaattgacaatgtgaaggcaaagattcaagacaaggaagggatccccctgaccagcagcgattgatct

SEQ ID NO: 1808 - DNA, 627 bp, Artificial
  Synthetic
caataatccgtcatgcagatcttcgtgaaaaccctaacgggaaagaccataaccctcgaagtcgagagcagcgacaccatcgacaatgtcaaggccaaaattcaggacaaagaagggatacctcctgatcagcagaggttgatttttgctggaaaacagttggaagatggtcgaactctggctgattacaatatccagaaagaatcaacacttcacctggttttgaggctcaggggaggaactatgattaaggtgaagactctcactggaaaggaaattgagattgatattgaacccacagacaccattgatcgaattaaggaacgagttgaggaaaaagaaggaatacctcctgtgcagcaaaggcttatttatgctggaaagcagctagctgatgacaagaccgctaaggattacaatattgaaggaggttctgttcttcatctcgttcttgcattgatgggtggtagtctttagaatgctccgaatttgggtaaaaatgtgcaacctttatccacgaatttatcatgacagttctcttttgttttctttttaccttttctcatgtaaaacatgaaaacttggttaaagctgactagctgagattgatttccccttataaaaaaa

SEQ ID NO: 1809 - DNA, 644 bp, Artificial
  Synthetic
ttacaatatccagaaggaatccaccctccacttggttctcaggctccgtggtggtatgcagattttcgttaaaaccctaacggtaaagacgattactcttgaggtggagagctctgacaccattgacatcgtcaaggccaagatccaagataaggagggtattcctccggaccagcagaggttgatcttcgccggaaagcaacttgaggacggcagaactttggcggattacaacatccagaaggagtctacgcttcatttggtcttgcgtctgcgtggaggtatgcagatcttcgtaaagactttgaccggaaagaccatcactcttgaagttgagagctccgacaccattgataacgtgaaggctaagatccaggacaaggaaggcattcctccggaccagcagcgtctcatcttcgctggaaagcagcttgaggatggacgtactttggccgactacaacatccagaaggagtctactcttcacttggtcctccgtctccgtggtggtttctaaaccttgtctctctctcttatggttactgaaccaagttcatgtatcgtttcatctagtactttggtggtttatgttttggggccatgtacagcctctgataaataattgatcgactatgtttccgtta

SEQ ID NO: 1810 - DNA, 344 bp, Artificial
  Synthetic
cgacaatgttaaagccaaaatccaggacaaagagggcataccacctgatcaacagaggctgatttttgctggtaagcaattggaagatggccggaccttagctgattacaacatccagaaagagtctactcttcatcttgtcctcaggctcagaggtggaaccatgatcaaggtgaagacactcactggaaaagaaatcgagattgatatcgaaccaaccgacactattgatcggatcaaagaacgtgttgaagagaaagaaggcatccctcctgttcaacaaaggctcatatatgccggaaaacagcttgctgatgacaaaacggccaaagattatgcgatag

SEQ ID NO: 1811 - DNA, 853 bp, Artificial
  Synthetic
cgcggtatgcagatcttcgtgaagactctcaccggaaagactatcactttggaggtagagagctctgacaccattgacaacgtgaaggccaagatccaggataaggaaggaatccctccggaccagcagaggttgatctttgccggaaaacaattggaggatggtcgcactttggcggattacaacatccagaaggagacgacccttcacttggtgttgcgtctgcgaggaggtatgcagaaattcgtcaagactttgaccggaaagaccatcacccttgaagtggaaagctccgacaccattgacaacgtcaaggccaagatccaggacaaggagggaatcccccctgaccagcagcgcctcatctttgccggtaaacagctcgaagacggccgcacccttgccgattacaacatacagaaggagtctaccctccaccttgtccttcgcctcaggggcggtatgcaaatcttcgtcaaaaccctcactggcaagaccattacccttgaagtcgagagttctgataccatcgataatgtgaaagccaagatccaagataaggagggaattccccctgaccagcagcgccttatctttgctggtaaacagcttgaagatggccgcaccctcgctgattacaacatacagaaggagtctaccctccaccttgtccttcgcctcaggggtggtatgcaaatcttcgtcaaaaccctcaccggcaagaccattactcttgaagtcgagagttctgacacaattgataacgtgaaagccaagatccaagataaggagggaattccccccgaccagcagaggctcatctttgctgggaagcaacttgaagatggtcgca

SEQ ID NO: 1812 - DNA, 733 bp, Artificial
  Synthetic
cccacgcgtccgctcaaaatcttaaaaactttctctcaattctctctaccgtgatcaagatgcagatctttgttaagactctcaccggaaagacaatcaccctcgaggtggaaagctccgacaccatcgacaacgttaaggccaagatccaggataaggagggcattcctccggatcagcagaggcttattttcgccggcaagcagctagaggatggccgtacgttggctgattacaatatccagaaggaatccaccctccacttggtcctcaggctccgtggtggtatgcagattttcgttaaaaccctaacgggaaagacgattactcttgaggtggagagttctgacaccatcgacaacgtcaaggccaagatccaagacaaagagggtattcctccggaccagcagaggctgatcttcgccggaaagcagttggaggatggcagaactcttgctgactacaatatccagaaggagtccacccttcatcttgttctcaggctccgtggtggtatgcagattttcgttaagacgttgactgggaaaactatcactttggaggtggagagttctgacaccattgataacgtgaaagccaagatccaagacaaagagggtattcctccggaccagcagagattgatcttcgccggaaaacaacttgaagatggcagaactttggccgactacaacattcagaaggagtccacactccacttggtcttgcgtct

SEQ ID NO: 1813 - DNA, 728 bp, Artificial
  Synthetic
tttatttttttaagaagaagttcgacttgtcattagaaagaaagagataacaggaacggaaacatagtagaacacttattcatcagggattatacaaggccccaaaacacaaaccaccaaagttttacatgaaacgaaacattgaacttcttaagcataacagagacgagatttaaaaaccaccacgaagacgcaggaccaagtgaagagtagactccttctggatgttgtagtcggccaaagtacgtccatcctcaagctgctttccagcgaagatgagacgctgctggtccggaggaataccttccttgtcctggatcttggccttgacgttgtcaatggtgtcggagctttccacttcaagggtgatggtctttccggtcaaagtcttgacgaagatctgcatacctccacgcagacgcaacaccaagtgaagggtcgactccttctggatgttgtaatccgccaaagtacgaccatcctccaattgttttccggcaaagatcaacctctgctggtccggagggattccttccttatcctggatcttggccttcacgttgtcaatggtgtcagagctctctacctccaaagtgatagtctttccggtgagagtcttcacgaagatctgcatacctccacgcagacgcaagaccaagtgaagtgtggactccttctgaatgttgtagtcagccaaagttcttccatcttcaagttgctttccggcg

SEQ ID NO: 1814 - DNA, 1218 bp, Artificial
  Synthetic
cccacgcgtccgctctcccaaagcctaaagcgatctctgcaaatctctcgcgactctctctttcaagatgcaaatcttcgtgaaaacactcactggcaagactatcactctcgaggttgagagctctgacaccatcgacaatgttaaggcaaagattcaggacaaggaaggcattcctccggatcagcaaagattaatattcgccggtaaacagctagaagatggccgtaccttggccgattacaacattcagaaagaatcaacccttcatttggttctccgtttaagaggtggtatgcaaatctttgtcaagactctgactggcaagaccattactttggaggttgagagctctgacactattgacaacgtcaaagcaaagatccaggacaaggaaggaatccctccggatcagcagagacttatctttgccggtaagcagcttgaagacggaagaactcttgctgactacaacattcaaaaggagtcgacccttcatttggtgcttcgtctcagaggtggtatgcaaatctttgtcaagaccctcactggtaaaacaatcacccttgaggttgagagttcagacaccattgacaatgtcaaagctaagatccaagataaagagggaattcctccggatcagcagaggcttatctttgccggtaagcagctcgaagatggacgcacccttgcagattacaacatccaaaaggagtcgacacttcatcttgtgcttcgtctccgtggtggtatgcagatctttgtgaagacccttaccggaaagaccattactctggaggttgaaagctcagacaccatcgataatgtcaaggctaagattcaggacaaggaagggatcccaccagaccaacagagactcatcttcgctggaaaacagcttgaggatggtcgcacacttgcagattacaacatccagaaggagtcgactcttcacttggttcttcgtcttcgtggtggaagcttctaagctttttgtgatctgatgataagtggttggttcgtgtctcatgcacttgggaggtgatctatttcacctggtgtagtttgtgtttccgtcagttggaaaaacttatccctatcgatttcgttttcattttctgcttttcttttatgtaccttcgtttgggcttgtaacgggcctttgtatttcaactctcaataataatccaagggcatgtttacccaaaaaaaaaaaac

SEQ ID NO: 1815 - DNA, 597 bp, Artificial
  Synthetic
gttggtcgaggcgaggagagcggcggcgaagaaggacaagtctggagccatgcagatcttcgtcaagacattgactgggaagacaatcaccctcgaggttgagtcgtcggacacgatcgacaatgtgaagaccaagatccaggacaaggaagggatccctcccgaccagcagcggctgatcttcgcgggcaagcagctggaagatggccggacgctggcggactacaacatccagaaggagtcgaccctccaccttgttcttcgcctccggggtggcggcaagaaaaggaagaagaagacgtacaccaagcccaagaagatcaagcacaagaagaagaaggtgaagctggcggtgctccagtactacaaggtggacgattcgggcaaggtgaacaggctgcgcaaagagtgcccgaatccagagtgcggtgccgggacgttcatggcgaaccactttgatcggcactactgcggcaagtgtggactcacctacgtctaccagagagctgaagcttagagaggatgacgagctttgctctctttccttgtgtttctatccaattttctttgaacgaaagtataatcttttcttttgtt

SEQ ID NO: 1816 - DNA, 604 bp, Artificial
  Synthetic
  misc_feature (422)..(422): The residue at this position can be any nucleotide.
gggcaggtagaggtggaggcaagcgggggaagatgcagatatttgtgaagaccctgacggggaagaccatcaccctcgaggtcgagagcagtgacaccatcgataatgtcaaagcaaagatccaagacaaggaaggaattccaccggatcagcagaggcttatttttgctgggaaacaactggaggatggtcgcacattggctgactacaatatccagaaagagtctactttgcaccttgttttgaggcttcgaggtggtatcatagagccttcgctgatggcgctcgccaggaagtataatcaagagaagatgatatgtcgcaagtgctatgctcgtcttcatcctcgcgctgtgaactgcagaaaaaagaaatgtgggcacagcaatcagcttcgaccaaagaagaagatcaagtaggtngttcggttgcagcctctccagatattcagaatcttgtttttttgctgatttgaggaaaagttgtttgagtgccatttaccatgttttggtgcaagtggcactcttattatgttaatctctgcgaagtaattactgacgatgagtcgtttgcatttgaattttcggaacaaaaggaatttgaa

SEQ ID NO: 1817 - DNA, 597 bp, Artificial
  Synthetic
ttgctttctctctctctgtctctctctttctgtctaccctttctctctctgtcctctgtttgagccaagaagaagatgcagatcttcgtgaagaccctgaccggcaagaccatcaccctcgaggtcgaaagctctgacaccatcgacaacgtcaaggccaagatccaggacaaggagggtatcccccctgaccagcagcgcctcatctttgctggtaaacagcttgaagatggccgcacccttgctgattacaacatacagaaggagtctaccctccaccttgtccttcgcctcaggggcggtatgcaaatcttcgtcaaaaccctcactggcaagaccattacccttgaagtcgagagttctgataccatcgataatgtgaaagccaagatccaagataaggagggaattccccctgaccagcagcgccttatctttgctggtaaacagcttgaagatggccgcaccctcgctgattacaacatacagaaggagtctaccctccaccttgtccttcgcctcaggggtggtatgcaaatcttcgtcaaaaccctcaccggcaagaccattactcttgaagtcgagagttctgacaca

SEQ ID NO: 1818 - DNA, 1210 bp, Artificial
  Synthetic
tcatcaattaggtttcttcgatagcaagtagcgatgcagatcttcgtcaagactctcaccggcaagactatcaccttggaggtggagagctccgacaccatcgacaacgtcaagaccaagatccaggacaaggaagggatccctccggatcagcagcggttgatctttgccggcaagcagcttgaggacgggcgtaccctcgccgactacaacatccagaaggagtctacgctgcatcttgttcttcggctgcgaggaggtatgcaaatattcgtcaagaccctaacgggtaagacgatcaccctggaggtggagagctccgacaccatcgacaacgtcaagaccaagatccaggacaaggaagggatcccgccggatcagcagcgtctgatcttcgctggcaagcagctcgaggatggccgtaccctggccgactacaacatccagaaggagtcgacccttcatcttgtgctgcgtctgcgaggaggcatgcagatcttcgttaagaccctcactggtaagacgatcaccctggaagtcgagagctcggacaccatcgacaacgtgaagactaagatccaggacaaggagggaattcctccggaccagcagcggttgatcttcgcgggtaagcagctcgaggatgggcgcactcttgccgactacaacattcagaaggagtctacactccatttggtgctgcgtcttcgcggaggcatgcagatcttcgtcaagaccctcacgggtaagacgatcaccctggaagtcgagagctcagacaccatcgacaacgtgaagaccaagatccaggacaaggagggaattcctccggatcagcagcggttgatcttcgcgggtaagcagctcgaagatgggcgcactctcgccgactacaacattcagaaggagtctactctccatttggtgctgcgtcttcgcggaggcatgcagatcttcgtcaagaccctcacgggtaagacgatcacgttggaggtggagagctcggacacgattgacaacgtgaagaccaagatccaggacaaggagggaattcctccggaccagcagaggctgatcttcgccgggaagcagctcgaggatggccgcactcttgcggactacaacatccagaaggagtctactctccatttggtgctccgtcttcgtggaggccagtagatagcatgtagcgcgttagcgcgtgaagtat

SEQ ID NO: 1819 - DNA, 602 bp, Artificial
  Synthetic
aagatgcagatcttcgtgaagaccctgacgggcaagaccatcacgctcgaagtcgagagcagtgacaccatcgacaacgtcaagtccaagatccaggacaaggagggtattcccccggaccaacagcgcctgatcttcgccggaaagcaactcgaggatggccgcactctgtccgactacaacatccagaaggagtcaaccctccacttggtcctccgtctccgtggtggtatcattgagccttcgctgaaggcgcttgcctccaagtacaactgcgacaagatgatctgccgcaagtgctacgcacgtctgccaccgagggctgtcaactgccgcaagaagaagtgcggtcacaccaaccagctccgccccaagaagaagttgaagtaaactactcgctcctatcggcgtctggcgaagagagcaacggggtcggtggatacgaattgcaacgattgcatgcgatggatatgagggctaggtcactactacttcttccacggcacatggcatcaatggagtgcttgtcttgtctcgcatttgggactttatgaagggaaccaggcatgtagagtgaatcgattcaaattcaaaaaccacca

SEQ ID NO: 1820 - DNA, 1274 bp, Artificial
  Synthetic
cgacccacgcgtccgcttttgtgggcgattcctgggtaatttcatacagcggcaactatgcagatcttcgtcaagacactgactggcaagacgatcactctggaggtcgagagctcggacacgatcgataatgtgaagaccaagatccaggacaaggaagggatccccccggaccagcagcgtctcatcttcgccgggaagcagctcgaagacgggcgaatcttggctgactacaacatccagaaggaatccactctccatctcgtcctacgtcttcgcggaggcatgcagatctttgtcaagacgctgaccggcaagaccatcactctggaggtcgagagctcggacacgatcgataatgtgaagaccaagatccaggacaaggaagggatccccccggaccagcagcgtctcatcttcgccgggaagcagctcgaagacgggcgaaccttggctgactacaacatccagaaggaatcgactctccatctcgtcctacgtcttcgcggaggcatgcagatctttgtcaagacgctgaccggcaagaccatcactcttgaggtcgagagctcggacacgatcgataatgtgaagaccaagatccaggacaaggaagggatccccccggaccagcagcgtctcatctttgctgggaagcaactcgaagacgggcgaaccttggccgactacaacatccagaaggagtcgacccttcacttggtgctgcgtctccgtggaggcatgcagatcttcgtcaagaccctgaccggcaagaccatcaccctcgaggtggagagctccgacacgattgacaacgttaagacgaaaatccaggacaaggaagggatccctcctgaccagcagcgcctcatcttcgccggcaagcagctcgaggatggacgaactctcgccgactacaacatccagaaggaatccacccttcacctggtgctgcgtctccgcggaggcatgcaaatcttcgtcaagaccctgaccggcaagaccatcacgctcgaggtcgagagctccgacacgatcgacaacgtaaagaccaagatccaggacaaggaagggatccccccggaccagcagcgactcatctttgccgggaagcagctcgaggatggcaggactctggccgactacaacatccagaaggaatccacccttcacctggtgctgcgtctccgcggaggcatgcaaatcttcgtcaagaccctgaccggcaagaccatcactctggaggtggagagctcggataccatcgacaacgt

SEQ ID NO: 1821 - DNA, 400 bp, Artificial
  Synthetic
agaagagaggctcagcgttcaagatgcagatcttcgtcaagaccctcacgggcaagaccatcactctcgaggtcgagagctccgataccattgacaatgtcaagtccaagatccaggacaaggagggcattcccccggaccagcagcgtctgatcttcgccggaaagcagctcgaggatggccgcactctttcggactacaacatccagaaggagtccaccctccacttggtcctccgccttcgtggtggtatggccaagaagcgcaagaagaaggtgtacaccacccccaagaagatcaagcacaagcgcaagaagaccaagctagctgtcctcaagtactacaaggttgacggcgatggcaagatcgagcgtcttcgccgcgagtgcccccaccccga

SEQ ID NO: 1822 - DNA, 533 bp, Artificial
  Synthetic
gaaagacgcacagttttctttgcagacgacaccgaaatgcagatttttgtcaagacccttaccggtaagactatcaccctcgaggtggagtcttccgacaccatcgacaacgtcaagtccaagatccaggacaaggagggaattcccccggaccagcagcgacttatcttcgccggtaagcagctcgaggacggccgaaccctttctgactacaacatccagaaggagtccactctccatctcgtcctgcgacttcgaggtggtggtaagaagcgaaagaagaaggtctacaccacccccaagaagatcaagcacaagcgaaagaagaacaagcttgctgtcctcaacctctacaaggttgacgatgacggaaaggttgagcgacttcgacgagagtgtgagtctgagtcctgcggtgccggtgtcttcatggctgacatgaaggaccgacagtactgcggccgatgccacctcaccctcaaggcctaaatgtattgatttagtttagtatatttatctcttgaacaaaaaaa

SEQ ID NO: 1823 - DNA, 636 bp, Artificial
  Synthetic
ggtgatttctaaacatgcagatctttgtgaagaccttgaccggcaagactatcaccctcgaggtggagagctcggataccatcgacaacgttaagaccaagatccaggacaaggaagggatcccaccggaccagcaacgattgatcttcgccgggaagcagcttgaggacggacggacccttgcggactacaacatccagaaggaatccacgcttcacctggttcttcgtctccgcggtggcatgcagatatttgtgaagaccttgaccggcaagaccatcaccctcgaggtggagagctcggataccatcgacaatgtcaagaccaagatccaggataaggaggggattcctccggaccagcagcgacttatcttcgccgggaagcaactcgaggacggacggacccttgccgactataacatccagaaggagtcgactctccacttggttcttcgtctccgcggtggcatgcagatatttgtgaagacactgaccggcaagaccatcaccctcgaggtggagagctcggataccatcgacaatgtcaagaccaagatccaggataaggaggggattcctccggaccagcagcgtttgatcttcgctgggaagcagctcgaggacggacggaccc

SEQ ID NO: 1824 - DNA, 454 bp, Artificial
  Synthetic
gcgacagttagcaggaatcatcgacaacaatgcaaatctttgtcaagacccttactggcaagactatcaccctcgaggtggagtcctctgacaccattgacaacgtcaagtccaagatccaggacaaggagggaatccccccggaccagcagcgacttatcttcgccggtaagcagctcgaggacggccgaactctttccgactacaacatccagaaggagtccactctccatctcgttctgcgactccgaggaggtatcatcgagccctctctcaaggctcttgcctccaagtacaactgtgagaaggccatctgccgaaagtgctacgcccgacttcctcctcgagccaccaactgccgaaagaagaagtgcggacacaccaaccagctccgacccaagaagaagctcaagtaaactattcgcatgtatggtatatgtataaaaattctgtt

SEQ ID NO: 1825 - DNA, 914 bp, Artificial
  Synthetic
tccgcaacatctgaagattgcttaggacggcaataggtctattgtcgaggtatgtctgaaagatgctgcatttctatctgccctccatgagctccgggagcttcatgagggaatcatcgttgatgtctccctcttgagcattcttctttgtttcccggagctctattccccaaatcccgagatattgctcgttgtcgcgaagaaatttgcaacacggcaattctcgccttcttctccccaaagtcaactcacgcaggcaatgtatgctgggcaaacaaatctaacccttccagttaggcaagatgcagattttcgtcaagaccctcacggggaagacgatcacccttgaggtggagtcttccgacaccatcgacaatgtcaagtccaagatccaggacaaggagggcattcccccggaccagcagcgattgatcttcgctggtaagcagctggaggatggccgaaccctctccgactacaacatccagaaggagtctaccctccacctggtcctgcgcctgcgtggtggtgccaagaagagaaagaagaaggtctacaccacccccaagaagattaagcacaagcgcaagaagaccaagttggctgtcctcaagtactacaaggtcagcaacgatggtaacatcgagcgtctccgccgcgagtgccccagcgagacttgcggtgctggtgtcttcatggctgccatgcctgaccgtcaatactgtggtcgttgccacctgacctacgtcttcgacaagcagtaaacgacaaaactttcaaaaagggaaaaaatttattgtggattggacagctggagccatgggactgccataacacacaaaggcgttgatgtagcattagagagcacatccggcggcttctggtaatgaatgcttgatttgagacacgtttgg

SEQ ID NO: 1826 - DNA, 629 bp, Artificial
  Synthetic
aaaaaagggaagaaatttttttcttttttttttgttcgcctccgcttcttcctcacgcagctctcgcctcgcctcgccgcccgccactagagaggagagggagaaggagaaggaggcgaatcccagcaaaagaagatgcagatcttcgtgaagaccctgacggggaagaccatcaccctcgaggtggagagcagcgacaccatcgacaacgtcaaggccaaaatccaggacaaggaagggatccctccagatcaacagcgtttgatattcgccggcaagcagctggaagatgggcgcacactggccgactacaacattcagaaggagtcaactcttcacttggtcctcaggctcaggggtggcactatgatcaaggttaagaccctcactggaaaagagattgaaattgacattgagcccaccgacacgatcgataggatcaaggagcgtgttgaggagaaagaaggcattcctcccgtgcagcaaaggcttatctatgctggtaagcagcttgccgacgacaagactgcgaaggactataacatcgaaggtggctctgtcctccatcttgtccttgctctgaggggtggttattagtaaagctaatgtgctagtacttagctcaatac

SEQ ID NO: 1827 - DNA, 1646 bp, Artificial
  Synthetic
cgaaaaatttctccccaatctcgcgaggctctcgtcgtcgaatcgaatcctctcgcgtcctcaagatgcagatctttgtgaagacattgaccggcaagactatcaccctcgaggtggagtcctctgacaccatcgataatgtcaaggctaagatccaagataaggagggcatccccccggaccagcagcgtctcatcttcgctggcaagcagctggaggatggcaggacccttgctgactacaacatccagaaggagtcgacccttcaccttgtcctccgcctccgtggtggcatgcagatctttgtcaagactctgaccggcaagactatcacccttgaggtggagtcttctgacaccatcgacaacgtcaaggccaagatccaggacaaagagggcatccccccagaccagcagcgtctcatcttcgccggcaagcagctggaggatggcaggacccttgctgactacaacatccagaaggagtccaccctccaccttgtcctccgcctccgtggtggcatgcagatctttgtcaagacactgaccggcaagaccatcaccctcgaggtggaatcttctgacaccatcgacaacgtcaaggccaagatccaggacaaggagggcattcccccggaccagcagcgtctcatctttgccggcaagcagcttgaggacggcaggacccttgctgactacaacatccagaaggagtcaacgcttcaccttgtcctccgtctcaggggaggcatgcaaatcttcgtgaagactctgaccggcaagaccatcaccctcgaggtggagtcttctgataccatcgacaatgtcaaggccaagatccaggacaaggagggcattcccccggaccagcagcgcctcatctttgctggcaagcagctggaggatggcaggacccttgctgactacaacatccagaaggagtccaccctccaccttgtgctccgccttcgtggtggtatgcagatctttgtcaagaccctcacaggcaagaccatcaccctggaggttgagagctcggacaccatcgacaacgtcaaggccaagatccaggacaaggagggcatccccccagaccagcagcgtctcatcttcgccggcaagcagctcgaggatggccgcaccctcgccgactacaacatccagaaggagtctaccctccacctggtgcttcgtctccgtggtggtatgcagatcttcgtgaagaccttgactgggaagaccatcactttggaggttgagagctccgacaccattgataatgtgaaggccaagatccaggacaaggaggggattcccccagaccagcagcgtctgatcttcgctggcaagcagctggaggatggacgcaccctcgccgactacaacatccagaaggagtccaccctccacctggtgctccgcctccgtggtggtcagtaatcagccagtttggtggagctgccgatgtgcctggtcgtcccgagcctctgttcgtcaagtatttgtggtgctgatgtctacttgtgtctggtttaatggaccatcgagtccgtatgatatgttagttttatgaaacagtttcctgtgggacagcagtatgctttatgaataagttggatttgaacctaaatatgtgctcaatttgct

SEQ ID NO: 1828 - DNA, 1002 bp, Artificial
  Synthetic
aatttctccccaatctcgcgaggctctcgtcgtcgaatcgaatcctctcgcgtcctcaagatgcagatctttgtgaagacattgaccggcaagactatcaccctcgaggtggagtcctctgacaccatcgataatgtcaaggctaagatccaagataaggagggcatccccccggaccagcagcgtctcatcttcgctggcaagcagctggaggatggcaggacccttgctgactacaacatccagaaggagtcgacccttcaccttgtcctccgcctccgtggtggcatgcagatctttgtcaagactctgaccggcaagactatcacccttgaggtggagtcttctgacaccatcgacaacgtcaaggccaagatccaggacaaagagggcatccccccagaccagcagcgtctcatcttcgccggcaagcagctggaggatggcaggacccttgctgactacaacatccagaaggagtccaccctccaccttgtcctccgcctccgtggtggcatgcagatctttgtcaagacactgaccggcaagaccatcaccctcgaggtggaatcttctgacaccatcgacaacgtcaaggccaagatccaggacaaggagggcattcccccggaccagcagcgtctcatctttgccggcaagcagcttgaggacggcaggacccttgctgactacaacatccagaaggagtcaacgcttcaccttgtcctccgtctcaggggaggcatgcaaatcttcgtgaagactctgaccggcaagaccatcaccctcgaggtggagtcttctgataccatcgacaatgtcaaggccaagatccaggacaaggagggcattcccccggaccagcagcgcctcatctttgctggcaagcagctggaggatggcaggacccttgctgactacaacatccagaaggagtccaccctccaccttgtgctccgccttcgtggtggtatgcagatctttgtcaagaccctcacaggc

SEQ ID NO: 1829 - DNA, 568 bp, Artificial
  Synthetic
gggaagcgaagctttgcgttctctaatcgcctcgtcaagatgcagatattcattaagaccctcactggcaagaccatcaccttggaggttgagtcctccgatacgattgacaatgtgaaggctaagattcaggacaaggagggcatccctccggaccagcaacgccttatcttcgctggcaagcagcttgaggatgggcgtactctcgcggattataacatccagaaggagtccaccttgcaccttgtcctccgccttcgtggaggcatgcaaatattcgtgaagaccctcaccggcaagaccattaccctggaggtcgagtcctccgacacgatcgataatgtgaaggccaagatccaggacaaggagggaatcccaccagaccagcagcgtctcatctttgctgggaagcagctcgaggatggccgcacccttgcagactacaacatccaaaaggaatccaccctgcaccttgtcctgcgcctccggggcggtatgcagatctttgtgaagacccttactggcaagacgatcaccttggaggttgagtcctctgacacgatcgaca

SEQ ID NO: 1830 - DNA, 557 bp, Artificial
  Synthetic
cccagaccagcaaaggctgattttcgcagggaagcaactggaagatggacgtacattagctgattacaacattcagaaagagtcaacgctccatttggtcctgaggctcaggggtggaaccatgatcaaggtgaagacactcactgggaaggaaatcgagatcgacatcgagcccactgataccattgatagaatcaaggagcgtgttgaggagaaagagggtattccacctgttcagcagaggctcatttatgctgggaagcaacttgctgatgataaaactgccaaggattacaacattgaaggtggctcagtgctccatctcgtgcttgctctgaggggtggtcagtagatgtagtttccatgcccgcattatctctaaagggagaagcatatttgctattccatttctatctgtagttgctgcagacttatagctatatttggtaggattattgaagtactatgcgattggcgcattgtgtattggaatcaattgtcatctgtactggaaaggaaatattggaactaagttaagcagtagtttatcaattgcc

SEQ ID NO: 1831 - DNA, 280 bp, Artificial
  Synthetic
tggtatcaacgcagaggggccattacggcggggccagcaaaggttgatttttgctggtaagcaattggaagatggccgtaccctagctgattacaacattcaaaaggagtcgactttgcaccttgtgctccgtcttcgtggtgggatgcagattttcgtgaagacattgaccgggaaaaccatcactcttgaggtggaaagctctgacactattgacaacgttaaggccaaaatccaggataaggagggaatcccaccagaccagcagagattgattttt

SEQ ID NO: 1832 - DNA, 1113 bp, Artificial
  Synthetic
atacaaacacttctcacatctcttccaccctaaggaatatccgttaacagcgcatcttcttgcactctctacgaatctcccagcggccaacgcttaatccgccaccatgcaaatcttcgtcaagaccctcaccggcaagaccatcaccctcgaggtcgagtcttccgataccatcgacaatgtgaagtccaagatccaggataaggaaggcattcctcctgaccagcagcgtctgattttcgctggcaagcaactcgaggatggccgaactctgtccgactacaacatccagaaggagtccaccctccacctggtcctccgccttcgtggtggtatgcagatcttcgtcaagaccctcactggaaagaccatcaccctcgaggtggagtcatctgataccatcgacaacgtcaagtccaagatccaggacaaggagggtatccctcctgaccagcagcgactgatcttcgctggtaagcagcttgaggatggccgaaccctctccgactacaacatccagaaggagtccactctccaccttgtccttcgtctccgtggtggtatgcagatcttcgtcaagacgttgaccggcaagaccatcacattggaggttgaatcatcagacaccatcgacaatgtcaaatcaaagattcaggacaaggagggtattcccccggatcagcagcgtcttatctttgctggcaagcagcttgaggacggtcgcaccttgagcgactacaacattcagaaggagagcacacttcaccttgtcctccgtcttcgtggtggtatgcagattttcgtcaagactctgaccggcaagacaatcaccctcgaggtggaatcttccgacaccatcgacaacgttaagtccaagattcaggacaaggagggcattcctcctgaccagcagcgcttgatctttgctggtaagcagctggaagacggtcgcaccttgagcgactacaacatccagaaggagagcacactgcacttggtcctgcgtctgcgtggtggccagtaaatgtgtcttttgcttacgaccgcactgttacgactgaattggacggttgggcgtttttgggaactttttttcaaagcagatatgggaac

SEQ ID NO: 1833 - DNA, 1604 bp, Artificial
  Synthetic
acgaaaatctcaacttttctctttacttcaaacgcctctcaagatgcagatcttcgtcaaaacccttaccggaaagacgataacccttgaggttgaaagctccgacacaattgacaacgttaaggctaagattcaggacaaagaaggaatcccaccggaccagcaaaggttgatcttcgccggaaagcagctcgaagacggcagaaccctagctgattacaacatccaaaaggaatccacccttcacttggtgctccgtcttcgtggcggtatgcaaatctttgttaaaaccctaaccgggaaaacaataacccttgaagtcgaaagctctgacacaattgacaatgtcaaggcgaagattcaggacaaggagggaatccctccagaccagcaaaggttgatttttgccggaaagcaactcgaagacggcagaaccctagctgattacaacatccagaaggaatcgacccttcacttggtccttcgtcttcgtggtgggatgcagatcttcgtcaaaaccttaactgggaaaacaatcacccttgaagtcgaaagctccgacaccattgacaatgtcaagggtaaaatccaggataaggagggaatcccaccagaccagcaaaggttgatttttgctggtaagcaattggaagatggccgtaccctagctgattacaacattcaaaaggagtcgactttgcaccttgtgctccgtcttcgtggtgggatgcagattttcgtgaagacattgaccgggaaaaccatcactcttgaggtggaaagctctgacactattgacaacgttaaggccaaaatccaggataaggagggaatcccaccagaccagcagagattgatttttgctggtaagcagctggaggatggccgaaccctcgctgattacaacattcagaaggagtctacccttcacttggttctccgtctccgcggtgggatgcagatcttcgtcaaaacactcactgggaagacaatcaccctcgaagttgaaagctccgatactatcgacaatgttaaggctaagattcaggacaaggaaggtattccaccggaccagcagagattgatttttgctggtaagcagttggaagatgggagaactttagctgattataatatccagaaggaatccacactgcatttggtgctccgtcttcgtggtgggatgcagatttttgtgaagacgttgaccgggaaaaccatcactttggaggtagagagttctgatacgatcgacaatgtgaaggctaagattcaggacaaggagggtatcccgccagatcagcagaggctgatttttgctgggaagcagttggaagatggaaggactctggctgattataatattcagaaggagtcgactctgcaccttgtcctccgtctccgtggtggtttctaaagtgtccgtcaatagtggtggtaatgtctgtgtcttgggtcttgggtctgttcggtgtttgtttgattcatgatttagtagtttgtgtagtttttgttagttgtcatcatgttatgccttcaaaagaaggaaggagacttgtcctctttgtctctgtttgcgaataataaagttcgaattatggttt

SEQ ID NO: 1834 - DNA, 658 bp, Artificial
  Synthetic
gccgccgcagcagcaaggagctagagagacaaaggggagagagccccggggaagaagaagaagcagcagctagggcgccaagatgcaaatcttcgtgaagaccctgactgggaagaccatcaccctcgaggtggagagcagcgacaccatcgacaatgtcaaggctaagatccaggacaaggagggaatcccgccggaccagcagcggctgatcttcgccgggaagcagctggaggacggacgcaccctggctgactacaacatccagaaggagtccaccctccacctcgtcctcaggctccgtggcggtatcatcgagccgtcgcttcaggcgcttgcccgcaagtacaaccaggacaagatgatctgccgcaaatgctatgcgcgcctgcaccctagggctgtcaactgccgcaagaagaagtgtggtcacagcaaccagctgaggcccaagaagaagatcaagaactagagcgtcactcgccgggttcatggactggttaaatcaatcgtcatattagacttttatgcttccgttgttatctccctggatgttgttgaaccgtgttttactgtgctggatgcttcagcttcttgttttgacggtcgtggtatatggtaattggcagcaaactatattggtcatgtcgaaattgtc

SEQ ID NO: 1835 - DNA, 405 bp, Artificial
  Synthetic
ttttctctctttattcaaacgcctctcaagatgcagatcttcgtcaaaaccctaactggaaagacgataacccttgaggttgaaagctccgacacaattgacaacgttaaggcgaagattcaggacaaggaaggaattccaccggatcagcagaggctgatcttcgccggaaagcagctcgaagacggcagaaccctagccgactacaacatccagaaggaatcgactcttcacttggtgctccgtcttcgtggcggtatgcaaatcttcgtcaaaaccctaacagggaaaacaatcacccttgaagttgaaagctccgacactattgataacgttaaggcgaaaatccaggataaagagggaatcccaccagatcagcagaggttgatctttgctggcaaacag

SEQ ID NO: 1836 - DNA, 1390 bp, Artificial
  Synthetic
cttgaggtcgagtcctcggacacgatcgagaatgtgaaggccaagatccaggacaaggagggcatccccccggaccagcagcgtctcatcttcgctggcaagcagctggaggacggccgcacccttgccgactacaacatccagaaggagtccaccctccaccttgtgctcaggctcaggggtggtatgcagatcttcgtcaagaccctgaccggcaagaccatcacgcttgaggtcgagtcctcggacacgatcgacaacgtgaaggccaagatccaggacaaggagggtatccccccggaccagcagcgcctcatcttcgccggcaagcagctggaggatggccgcaccttggctgactacaacatccagaaggagtccacccttcacctggttctcaggctcaggggtgggatgcagatcttcgtgaagaccctgactggcaagaccattacccttgaggttgagtcgtccgacactattgacaacgtgaaggcgaagatccaggacaaggagggcatccccccggaccagcagcgtctgatctttgctggtaagcagcttgaggatggccgcaccctggccgactacaacatccagaaggagtccaccctccaccttgtgctcaggctcaggggaggcatgcagatcttcgtcaagaccttgactggcaagaccatcacccttgaggtcgagtcgtctgacaccattgacaatgtcaaggccaagatccaggacaaggagggcatccccccggaccagcagcgtctcatcttcgctggcaagcagcttgaggatggccgcaccctggccgactacaacatccagaaggagtctaccctccaccttgtgctcaggctcaggggaggcatgcagatcttcgtcaagaccttgactggcaagaccatcacccttgaggtcgagtcgtctgacaccattgacaatgtcaaggccaagatccaggacaaggagggcatccccccagaccagcagcgtctcatcttcgccggcaagcagctggaggatggccgcacccttggtgactacaacatccagaaggagtccaccctccaccttgtgctcaggctcaggggaggtatgcagatcttcgtcaagagcctgaccggcaagaccatcaccctcgaggtcgagtcctcggacacgatcgacaacgtgaagggcaagatccaggacaaggagggcatccccccggaccagcagcgtctcatcttcgccggcaagcagctggaggacggccgcacccttggcgactacaacatccagaaggaatccaccctccaccttgtgcttaggctcaggggaggtatgcagatcttcgtcaagaccctgactggcaagaccatcacacttgaggtcgagtcctcggaca

SEQ ID NO: 1837 - DNA, 782 bp, Artificial
  Synthetic
gaattcagattctctttttgcgatctaaaggatcttcttcaattctccttcaagatgcagatctttgtgaaaactcttactggtaagaccatcacccttgaggtcgagagctcagacacaattgacaacgttaaggctaagattcaagacaaggaaggaattcctccagaccaacaacgtttgatcttcgccggaaagcagttggaagatggaagaactttagctgactacaacatccagaaggaatcaactctccatcttgtccttcgtcttagaggtggtatgcaaatctttgtcaaaaccttgactggtaagaccatcactttggaagtcgagagctctgacaccattgataacgttaaggctaagattcaagataaggaaggaattcctccagaccagcaacgtttgatcttcgccggaaagcagttggaagatggtcgtactcttgccgactacaacatccagaaggagtctactctccatttggttcttcgtctcagaggtggtatgcagattttcgtcaagacccttactggaaagaccatcaccttggaggttgagagttccgacaccatcgataatgtcaaggctaagattcaagataaggagggtatccccccagaccagcaacgtttgatcttcgccggaaagcagctggaagatggtcgcactcttgccgactacaacattcagaaggagtctaccctccatttggtgcttcgtcttagaggtggtatgcaaatcttcgtgaagaccttgaccggaaagaccatcactct

SEQ ID NO: 1838 - DNA, 604 bp, Artificial
  Synthetic
cccggaccttgctccacacccgcagcagcagcagcagcaaggggaagaagaagagccaagatgcagatcttcgtgaagaccctaacggggaagaccatcacgctcgaggtcgagagcagcgacaccatcgacaatgtcaaggccaagatccaggacaaggaaggcatccctccggaccagcagcgcctcatcttcgccggcaagcagctggaggatggccgcaccctggccgactacaacatccagaaggagtccacgctccacctcgtcctccgcctccgcggtggcatcatcgagccctccctccaggccctcgcccgcaagtacaatcaggacaagatgatctgccgcaagtgctatgctcggctgcaccccagggctgtcaactgccgcaagaagaagtgcggccacagcaaccagctgaggcccaagaagaagatcaagaactagagtttgagatatcatttccgcggatcattgaaatcaacaggaagatcagagtttaagtttttttgtagtgtaatgcctcatgttgtatgccgaactttctgtttatcctgttgtatgttaaccttggttacgctggagagtactccagcttatt

SEQ ID NO: 1839 - DNA, 1439 bp, Artificial
  Synthetic
cccaaaatcgcagagaagaaaaaatctcccctcgaagcgaagcgtcgaatcgccttctcaagatgcagatctttgtgaagaccctcaccggcaagaccatcaccctcgaggttgagtcctcggacaccattgacaatgtcaaggccaagatccaggacaaggagggcatccctccggaccagcagcgtctcatcttcgctggcaagcagcttgaggatggccgcaccctggccgactacaacatccagaaggagtccaccctccaccttgtgctcaggctcaggggaggcatgcagatcttcgtcaagaccttgactggcaagaccatcacccttgaggtcgagtcgtctgacaccattgacaatgtcaaggccaagatccaggacaaggagggcatccccccagaccagcagcgtctcatcttcgccggcaagcagcgggaggatggccgcacccttgctgactacaacatccagaaggagtccaccctccaccttgtgctcaggctcaggggaggtatgcagatcttcgtcaagaccctgaccggcaagaccatcaccctcgaggtcgagtcctcggacacgatcgacaacgtgaaggccaagatccaggacaaggagggcatccccccggaccagcagcgtctcatctttgctggcaagcagctggaggatggccgcacccttgccgactacaacatccagaaggagtccaccctccaccttgtgctcaggctcaggggtggtatgcagatcttcgtcaagaccctgaccggcaagaccatcacgcttgaggtcgagtcctcggacacgatcgacaatgtgaaggccaagatccaggacaaggagggtatccccccggaccagcagcgtctcatcttcgccggcaagcagctggaggatggccgcaccttggctgactacaacatccagaaggagtccacccttcacctggttctcaggctcaggggtgggatgcagatcttcgtgaagaccctgactggcaagaccattacccttgaggttgagtcgtccgacactattgacaacgtgaaggcgaagatccaggacaaggagggcatccccccggaccagcagcgtctgatctttgctggtaagcagcttgaggatggccgcacccttgcggattacaacatccagaaggagtccacactccacctggtgctccgcctccgtggtggccagtaagtcctcagccatggagctgctgctgttctagggttcacaagtctgcctattgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtcc

SEQ ID NO: 1840 - DNA, 665 bp, Artificial
  Synthetic
gaattcataatcgatcagattcttctaggcagtcttattcggcgatctaacctaaatttcttcgacacctctctgaagatgcagatttttgtgaaaaccctcactggcaagaccatcacacttgaggttgagagctcagacacaattgacaacgtgaaagctaagattcaagataaggaaggaattcccccggatcagcagaggttgatctttgctggcaaacagttggaagatggaagaactctagctgactacaacatccagaaagaatccactctccatctcgtcctccgtctcagaggtggtatgcaaatatttgtgaaaaccctcactggcaagaccattactttggaagtggagagttctgataccatcgacaatgtcaaggccaagatccaagataaggaaggtattcctccagaccagcagaggttgatttttgctgggaagcagttggaagatgggcgtacccttgctgactacaacatccagaaggaatccacccttcacctggttctacgactaagaggtggtattgcagatctttgtgaaaacgcttactggaaagaccatcaccttagaagttgagagttcagataccattgacaatgtaaaagccaaaattcaggacaaggaaggtattcctccagaccagcaacgtttga

SEQ ID NO: 1841 - DNA, 618 bp, Artificial
  Synthetic
ttcgtcaaaccctcaccggcaagaccatcaccctggaggttgaaagctccgacaccattgacaatgtcaaggccaagatccaggacaaggaggggattcccccagaccagcagaggttgatctttgcaggtaagcagttggaagatggtcgcacccttgcggactacaacattcagaaggagtccaccctgcacttggtgctgaggctgaggggaggaatgcagatcttcgtgaagacattgaccgggaagaccatcaccttggaggtggagagctctgacaccatcgacaatgtaaaagctaagatccaggacaaggagggtatcccacccgaccagcagaggttgatctttgctgggaagcagctcgaggatggaaggaccttggctgactacaatatccagaaagagtcaacccttcaccttgtcctccgtctccgtggtggtttctaggttgtctgttgttgatgacgtggtgtcctgttaattggctgtgttgtctgtttctagttgtggtcatgatgtgctttgtttgctgaggtctcaatgatgttccattctgtttctgttcgctgtttcttttatgttctctgttgtgaataaagattccgatttctgt

SEQ ID NO: 1842 - DNA, 279 bp, Artificial
  Synthetic
cccacgcgtccgctcaaaatcttaaaaactttctctcaattctctctaccgtgatcaagatgcagatctttgttaagactctcaccggaaagacaatcaccctcgaggtggaaagctccgacaccatcgacaacgttaaggccaagatccaggataaggagggcattcctccggatcagcagaggcttattttcgccggcaagcagctagaggatggccgtacgttggctgattacaatatccagaaggaatccaccctccacttggtcctcaggctcc

SEQ ID NO: 1843 - DNA, 1158 bp, Artificial
  Synthetic
attctcattatctcctcaacttttctctctttattcaaacgcctctcaagatgcagatcttcgtcaaaaccctaactggaaagacgataacccttgaggttgaaagctccgacacaattgacaacgttaaggcgaagattcaggacaaggaaggaattccaccggatcagcagaggctgatcttcgccggaaagcagctcgaagacggcagaaccctagccgactacaacatccagaaggaatcgactcttcacttggtgctccgtcttcgtggcggtatgcaaatcttcgtcaaaaccctaacagggaaaacaatcacccttgaagttgaaagctccgacactattgataacgttaaggcgaaaatccaggataaagagggaatcccaccagatcagcagaggttgatctttgctggcaaacagttggaagacggcagaaccctagccgactacaacattcagaaggaatcaactcttcacttggtactccgtcttagaggaggcatgcaaatcttcgtcaaaaccctaaccgggaaaacaatcacccttgaagtcgaaagctttgacacaattgacaatgtcaaggcgaagattcaggacaaggaaggaatcccaccagatcagcagaggttgatctttgcgggtaagcaattggaagatggaaggaccttagctgattacaatattcagaaggagtccaccctccatttggtgctccgtcttcgtggtggaatgcagatttttgtgaagactttgaccgggaaaacaatcactcttgaagttgaaagctcagatactattgacaacgttaaggccaagatccaggataaggagggtatcccaccagatcagcaaaggctgatctttgctggcaagcagttggaagatggtcgtactcttgctgattacaacattcagaaggagtcgactttgcaccttgtcctccgtctccgtggtggtttctaaagtgtccgtcagtggtggtggtgatgtctgtgtctgtgtcttgggtctttggtctgtttggtgtttgtttgattcatgatttagtactttgtgtagtttctgttagttgttatcatgttatctttccaatagaggcgaggagtcttgttttcttctgtctctgtttgtgaataataaagtcgaattattg

SEQ ID NO: 1844 - DNA, 622 bp, Artificial
  Synthetic
gggcaggtagaggtggaggcaagcgggggaagatgcagatatttgtgaagaccctgacggggaagaccatcaccctcgaggtcgagagcagtgacaccatcgataatgtcaaagcaaagatccaagacaaggaaggaattccaccggatcagcagaggcttatttttgctgggaaacaactggaggatggtcgcacattggctgactacaatatccagaaagagtctactttgcaccttgttttgaggcttcgaggtggtatcatagagccttcgctgatggcgctcgccaggaagtataatcaagagaagatgatatgtcgcaagtgctatgctcgtcttcatcctcgcgctgtgaactgcagaaaaaagaaatgtgggcacagcaatcagcttcgaccaaagaagaagatcaagtaggttgttcggttgcagcctctccagatattcagaatcttgtttttttgctgatttgaggaaaagttgtttgagtgccatttaccatgttttggtgcaagtggcactcttattatgttaatctctgcgaagtaattactgacgatgagtcgtttgcatttgaattttcggaacaaaaggaatttgaattgcattttagctttcag

SEQ ID NO: 1845 - DNA, 595 bp, Artificial
  Synthetic
cccacgcgtccggggtaaactgaagagtgcgccgcaaaatgcagatcttcgtgaaaaccctaaccgggaagacaatcacgctcgaggttgaatcgagcgacaccattgataatgtcaaggctaagattcaagacaaagaaggtattccaccggaccagcagcggttgatattcgccggaaagcagctcgaagatggacgtactcttgctgattataacatccagaaagagtcaactttgcatttggttttgaggcttcgtggagggattattgagccttctctgatggctttggctaggaagtacaaccaggataagatgatttgtcgcaagtgctatgctcgcctgcatcctcgtgctgttaactgcaggaagaaaaaatgtgggcacagcaaccagctgaggccaaagaagaagatcaagtagacgtgatgtcttttctaagcttagatcaattttgcgcgttgcagctatatattgccagtccgttgtttttacagttttcagtcctgcttcaatttgatgtcatggataacaaacatgtcttaaacatctaattattggataagatatctttgtgcactcaatatatgtct

SEQ ID NO: 1846 - DNA, 293 bp, Artificial
  Synthetic
ggcagagagaggagagggagagagagatgcagatcttcgtgaaaaccctaacagggaagaccatcactctcgaagtcgagagcagtgataccatcgacaatgtcaaagccaagatccaggacaaagaagggataccaccagatcaggagaggctgatatttggtggcaagcagcttgaagatgggcgcacactggctgattacaacatccaaaaggagtccacactggatctggtgctgaagttgcgtggagggaccatgatcaaggttaagaccctcaatgggaaggaaatt

SEQ ID NO: 1847 - DNA, 1523 bp, Artificial
  Synthetic
tcatcgccttcaaatttctctctcaaggtttgagaaaatttcctcaatttctcgctttaggagttcttttttattgaatcaccgatttgggtgtgtcaagccctaattttgaagttcattttttcaattgtttgttgttgattttatgttataacagatgcagatcttcgtaaaaaccctaaccggtaagaccatcactctcgaggttgagagttccgacacaatcgacaacgtaaaagccaaaatccaggataaggaaggaattcccccagatcagcaaaggcttatcttcgccggcaagcagcttgaggacggccgtaccctagccgattacaacatccagaaggaatctactcttcacttggtcctccgtctgcgtggtgggatgcagattttcgtcaaaaccctcactggcaaaacaatcacccttgaggtggaaagttctgacaccatcgacaatgtcaaggctaaaattcaggataaggagggaattccaccagaccagcagaggttgatcttcgctggcaagcagcttgaggatggtcgtacccttgccgattacaacatccagaaggagtctacccttcaccttgtcctccgtctccgtggtggtatgcagatctttgtcaaaacgctcaccggcaaaaccatcacccttgaggtcgagagttccgacaccatcgacaatgtcaaggccaaaattcaggacaaggagggcattcccccagaccagcagaggttgattttcgctggcaagcagctcgaggatggccgtacactagctgattataacatccagaaggaatccacccttcaccttgtcctccgtctccgtggtggtatgcagatcttcgtcaaaacactcaccggcaagaccatcaccctggaggttgaaagctctgacaccattgacaatgttaaggccaagatccaggacaaagaggggattcccccagatcagcagaggttgatcttcgcaggaaagcagttggaagatggtcgcacccttgcggactacaacattcagaaggagtctactctgcacttggtgctaaggctgaggggaggaatgcagatcttcgtgaagacattgaccgggaagaccatcaccttggaggtggaaagctctgacaccatcgacaatgtcaaagctaagatccaggacaaggagggtatcccaccggaccagcagaggttgatctttgctggtaagcagcttgaggatggaaggaccctggccgactacaatatccagaaagagtcaacccttcaccttgtcctccgtctccgtggtggtttctaggttgcctgttgttgatgttgttgtgtcgtgttgattggctgtgtcttgttgtggtcatgatgtgttttgtctactaaggtcccaaagatgttcaattctgtttctgttcgccgtttctttcatattttctgttgtgaataaagacaccagattctgtcctagtgcttaggttttgtgctctctgttggcagtaaatgaactttcctttgttttatccatt

SEQ ID NO: 1848 - DNA, 642 bp, Artificial
  Synthetic
attcttctctccctttgcgaaacaagctaactttctcccgagtctttttcttcttcctctcaagatgcagatctttgtaaagacactcactgggaaaaccattactcttgaggttgagagttcagacacaattgataacgtgaaggccaaaattcaagacaaggaagggattcccccagaccagcagaggctgatatttgctggaaagcagcttgaagatggccgaactcttgctgattacaatattcaaaaggagtctaccctccaccttgtcctccgtctacgtggtggtatgcagatttttgttaaaactcttactggcaaaaccattactcttgaggtcgagagttcagacaccattgacaatgttaaggccaagattcaagataaggaaggcattccacctgatcagcaaaggctgatctttgctggaaagcaacttgaggatggaaggtccctcgcggattacaacattcaaaaggagtcgaccctacatcttgtcctccgtctacgtggtggcatgcagatttttgttaaaactttaacgggcaagacgatcactcttgaagttgagagctcagataccattgacaatgtaaaggcaaagatccaggacaaggagggtattcctccagaccagca

SEQ ID NO: 1849 - DNA, 753 bp, Artificial
  Synthetic
ggccaagatgtcactgcatgggggtttcgttaatgaagctgttcagggcatgatatggtgcatgaggatgcacgagtggatactaacatatgacagttgatgctctttttatagagcatccgtttggatataaaagcatcgagtgtcgccaacattttgatcttgttccatccatcaatcgcatcaaccactctcaagcaacaataacaacctttacccaacttcaaagactttcagtctctcaactcaacaccttcaagatgtctccctggtgagtcttctgaggaccattggtccatcacttgctcgggagttcctctttgctttaccttcagcgttccactacctgatctatgataccttctttcccaccaccgagcaaagcactcattagacatgtcactaacgattttctttcaatagcgcatgcaactcctgtggatgcaaggacaactgctccagctgctcctgcaccagctgcagcgtaagtcctgcttctctcccctgctttgggcattgagaaacttttccaccagaaagctaacagatgggaacatatagcactaaatcatcgtgctctttttccttcgctggatctatactctctcggaatgacagcttgagggctcggatgtgcttaagacgccatgggaagggcaaggcatttgggcgaatagacctccatcatgtgggatatagcagaataggaatttgaagattttgccctaacacacatataatttgcttgtgaag

SEQ ID NO: 1850 - DNA, 701 bp, Artificial
  Synthetic
gtgcagctgataaattccatcgattggtttctttgggagcattaatcgacctttctcattcttcataccatcggcgtcgttggcatttatacggcatctcgtcttgtttccttcgtactcgaggtacggtaccctgaccgcgtcgtcatacgaatttgcagcatcggcgaattgacagtataaggcagacatcatggctgggtggcagtcctggaaccccttcagtaagagggagacgcacagcaatggctccatcgtcgcatacaagattttaaccttgctctcatggcttttgtccgtcgtcgtcactgtctactatgccgttgacgagcctcacgatggcttccacatccgccggcgcatatgggatcagaactatctgtatcccagcgcctttaccatgaaccacatcctcgctgatatctactggattgttctcttcatcctccagtttggatacgtcacatcgctcttctccagcagtgccgacgtcgttgccgcagctgctggtgtcggcagccacttcatcctcaacaacttgcttcactctgcattcgtcatgctctttgtgaactcgcacttccacatcgccgaggtcatactgattctcaacttcttcaacctcagctcactgtatttccgccacaacacggtcccgcgcttcattcacgtccctgttgctacaggcccgttggcatgga

SEQ ID NO: 1851 - DNA, 600 bp, Artificial
  Synthetic
agctgataaattccatcgattggtttctttgggagcattaatcgacctttctcattcttcataccatcggcgtcgttggcatttatacggcatctcgtcttgtttccttcgtactcgaggtacggtaccctgaccgcgtcgtcatacgaatttgcagcatcggcgaattgacagtataaggcagacatcatggctgggtggcagtcctgtaagagacaacgatcccaacaattcccattcttcacagcttgctaaaatccgcatcacagggaaccccttcagtaagagggagacgcacagcaatggctccatcgtcgcatacaagattttaaccttgctctcatggcttttgtccgtcgtcgtcactgtctactatgccgttgacgagcctcacgatggcttccacatccgccggcgcatatgggatcagaactatctgtatcccagcgcctttaccatgaaccacatcctcgctgatatctactggtaaattcgccatgactccatcaattctcgctcaagctttctgacacttgaaaaccaggattgttctcttcatcctccagtttggatacgtcacatcgctcttctccagcagtg

SEQ ID NO: 1852 - DNA, 588 bp, Artificial
  Synthetic
ggggaaatggtctgttttacttaattgtataacgaggtattacaatgtccagaccttaacaacggaaattaaaataccctagcttaaactgaccactaacacaaacagaaagcacaaacataaaatctacaatcactaacaacaaaatacaataaaccctaaccgccaatatttaacctccaaatccgtacaaggtccttccctgcctcttgagagcgtaaacaacatccatggcagtaacagtcttcctcctagcgtgctcagtgtaggtcacagcatcgcgaatcacattctccaaaaagatcttaagaactccacgagtctcctcgtaaatcaacccagaaatacgcttcacaccacccctacgagcaagcctgcgaatagctggctttgtaattccctggatgttatctctcagcactttcctgtgtctctttgctcctcctttccccaatcccttgcctcccttgccacgtccagacatttttcaaaagcttgagaaagagataattgaaagtgaattcaagggttttgaatttaaaagagaggaacgagcttcgattgttttgatgccccggccgtaatggc

SEQ ID NO: 1853 - DNA, 609 bp, Artificial
  Synthetic
tctgtttttgtgttagggaggaatatccatagccgtagccatgtctggtcgaggcaaaggagggaagggtctgggcaaggggggtgcgaagcggcatcgcaaggtctttcgtgataacattcagggtatcactaagcctgccattcgccgtcttgccaggaggggtggtgtcaagcgtatcagtggtctcatctacgaggagacacgtggcgtcctgaaaatcttcttggagaatgtgatccgtgatgctgtcacctacactgagcatgcccgcaggaagactgtcacagccatggatgtcgtctatgccctcaagagacagggaaagaccctctacggatttgggggttgaaacaccttctctctctctctctcttatactggtgttcttcaacaccaccattctgtagaaattggaagcttggttgaactgctttatgtgatgagacatgctgatgggatttaggggttcggatccttctgtaaatatctatggttttctatgctgatactctctatgcaatgaaaaagcatgaactcggtctctgtagctctgttggttaattctagattaaattgcccgtttctctatttgtatctctctctgga

SEQ ID NO: 1854 - DNA, 523 bp, Artificial
  Synthetic
tattggttgtctagggtgctagagcagcagcagctaggaaatctctcgtcgtcgcggcaatgtctggaagaggcaagggaggtaagggattgggcaagggcggcgccaagcgccaccgcaagcatctccgcgataacatccagggcatcaccaagccggcgatccggcgccttgcccggcgtggcggcgtcaagcgtatcagcggcttgatctacgaggagacccgaggcgtcctcaagatcttcctggagaacgtcatcagggatgcggtcacctacaccgagcacgccagaaggaagaccgtcaccgccatggacgtcgtctatgcgctcaagaggcaaggcaggacgctctacggatttggcggctagaagaagaaaattagaagctctccatctccttggaaaatttctagttttcctcgatttctaactggtagacaaggaagaaatattttcctttgcattccatccaccactttgtaatattcgaatctaatgtagaatcttaaatcggaaaaaaa

SEQ ID NO: 1855 - DNA, 604 bp, Artificial
  Synthetic
ccccgcacctcatcaccaccgccgccaaccactcctcaccaagtcaaagtttcttcctcgcgaccggcggcgagcggcggcggcggcgatgtctgggagaggcaagggcggcaaggggctcgggaagggcggcgcgaagaggcacaggaaggtgctgcgcgacaacatccaggggatcacgaagccggcgatccggaggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggattcggcggctaggcgaggcgatgcgaggccacgcgattggatagggattcgattagtgccatgttcttcagttcgtcgtagtagcctagcctcttctcctgtagctgttgtttcatctcgtctcctgttccttcattaattagggatgtatgaactactggttcgttcgttcgaatggaataggaaatctgcagtgatttaccctctaaattcagt

SEQ ID NO: 1856 - DNA, 615 bp, Artificial
  Synthetic
cccgactccaatcaccaccacctcttctccaattccactcgcttttctctctctctcgtgcgtcgagccaccggaatcgtcgtcgtcggcggccatgtcggggcgcggcaagggaggcaaggggctcggcaagggcggcgccaagcgtcaccggaaggtgctccgcgacaacatccaggggatcaccaagccggcgatccggaggctggcgaggaggggcggggtgaagcgcatctcggggctcatctacgaggagacccgcggggtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctgatcgatcttgcctccctccgccatctctcccatgtcgtctggccgtgcccacaagtcttgcggtcaagaaaaaaagtttgatggaaagccgtggaatccaccttgttcagttcgctgtttagtttttctagtgtttacctgaatcatgaaattgtgaagcaaatgatgtttgcaactgggatttgaattgaaacatgtttcagagcctaa

SEQ ID NO: 1857 - DNA, 634 bp, Artificial
  Synthetic
agcgatttcagatctccccaagtagtagacttctctcttcttccatctcggattcgtctcggtctcgtctcggtctccggcgatgtctgggcgcggcaagggaggcaaggggctgggcaagggcggggcgaagcgccaccgcaaggtgctccgcgacaacatccaggggatcaccaagccggcgatccggaggctggcgaggaggggcggcgtgaagcgcatctccgggctgatctacgaggagacccgcggcgtgcttaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagccctccggtcctccctcgccctcgcgctggccgcctctgccgccgccgcctcctggactggctgttgctggtgttttagctcttgttgtgtccttttgctttgctggtgtaaagagacccggatgtgccacgggtgggtttttagtagtaggattagtagtatcccaactcctggttgtgatttgctcatttccatagatgtaatgacattacgatttcaatcgtagcaaaattatttg

SEQ ID NO: 1858 - DNA, 556 bp, Artificial
  Synthetic
accacgcgtcgttcaaatctaaaaccctaaagcttcttttatcttcaaatttctgtgtgaaaatgtctggtcgtggaaagggaggaaagggattgggcaagggaggagctaagaggcacaggaaggtgctgagggataacatccaaggaattacgaagcccgcaattcgtcggttggctcgtaggggaggtgtgaagcgtatatctggtctgatctacgaagagacacgtggagtgctgaagatctttctagagaacgtgattcgtgatgctgttacctacaccgagcacgccaggagaaagactgttactgctatggatgtcgtttatgcactcaagaggcagggcaggactctctatggatttggtggttaggttgtttaggtgtgattttaggtaactgtatttgtagtaattgtagattttctggaatttctgttgtctctttgttggtttctccgcagctttgttctagttgttgttcttaaggtcttgataatgtaatttctcattacagattcaaggaacaaagttcattttctagaaaaaaaacaacc

SEQ ID NO: 1859 - DNA, 587 bp, Artificial
  Synthetic
ctaccctcgaccacgcgtcgctgatttcagttcacatcaaaacttggaaggtctttaatcttcaagttcctgtgtgaaaatgtctggtcgtggaaagggaggcaagggattgggcaaaggaggagcgaagaggcacaggaaggtgctaagggataacattcagggatttacgaagccagcaattcgtcggttggctcgtaggggaggcgtgaagcgtatttctggtctgatatatgaggagacacgtggtgtgctaaagatctttctagagaacgtgattcgtgatgctgttacctacactgagcacgccaggagaaagactgttactgctatggatgttgtgtatgcactcaagaggcagggtaggactctctacggttttggtggttaaggaatttgtgtttgtgtttttgacttttgtttgttcttcaaaagtcttgcggtcaagaaattgaatgaagtattattaaaatagttgatgtaattagggttccttattagtatttgtagtagttgttgtaagaaaagcattctcaggtattctggaatttgctcaacttaatggcagaagaattcaagtttcaact

SEQ ID NO: 1860 - DNA, 576 bp, Artificial
  Synthetic
ctagaaatcaacttttctcctttcaattactctataaaaaatgtcaggtcgtggaaagggaggcaaaggtttgggtaaaggaggagcaaaacgacaccgtaaggtgctccgtgataacattcagggaatcacgaaacctgccattcggagattagcgagaagaggtggagtgaagagaatcagcgggctgatttatgaagaaacaagaggagtgttgaagatatttttggagaatgtgattcgtgatgctgtgacttacactgagcacgccagaagaaagactgtcactgcaatggatgttgtttactctttgaagagacaaggcaggactctttatggatttggtggttaaagtttgggaaattgttgttaacttctgtgttactatttggtgttattgttaatgtagttgactagattttcgtattaatgaaatgaaatccgttggttttattctcattcttgtgtccatttgattttgagtctccgagtttttgattgagtgggaattgtagtatttttgtttgtttgtgttgctttaccttatgagtttgcacaatgtttattcaaaattca

SEQ ID NO: 1861 - DNA, 624 bp, Artificial
  Synthetic
gccattacggccggggagaatccgaatcaaccacatttttgctcatttcaaattcaaaaatccccaaaaatctagtttcacaatgtcaggaagaggaaagggtggaaaaggattgggcaaaggaggagctaaacgacaccgtaaggtgcttcgtgataacatccagggaatcacgaaacctgcaattcggcgtttggctcgtagaggaggagtgaaacgtatttctggtttgatttacgaggagacacgaggtgtattgaagatatttttggagaatgtgattcgtgatgctgtgacttacaccgaacatgccaggagaaagactgttactgctatggatgttgtttatgccctcaagaggcagggaaggactctctacggatttgggggttagatttgtctaattagagtttttgtggggtaatgattgtagatttgttctttactatctgatgtattagggttggttagtttttgttgagattttataatgtaattctctattacatactcaggaatagtaattgcccaaaaaaaatctaacaagcttctagtagtatatataacaagctcgcattcttaaaatcataaatcttggaacaaggttttttcttttctttctag

SEQ ID NO: 1862 - DNA, 503 bp, Artificial
  Synthetic
tatcgagttcaaatttcaaaatccccataatcgtttcacaaaatgtcaggaagaggcaagggaggtaaaggattgggtaaaggaggagcaaagaggcacagaaaagtattaagggacaacattcagggaatcactaagcctgcaattcggcgtttggctcgtaggggtggagtaaagcgtatttctggtttaatttacgaggagactcgtggggtgttgaagatatttttggagaatgtgattcgtgatgcagtgacatacactgaacacgctaggagaaagactgttactgccatggatgttgtttatgcgctcaaaaggcagggcaggactctttacggatttgggggttaaatttttcaaattagggtttttgtgggtaacttttattatagatttgtacttttgctgccgttgtgttttagggttgcttagattttggtaaggtcgatgatgtaattctcgttacatattcaaggaatagtaattgcttggtcctcaaa

SEQ ID NO: 1863 - DNA, 595 bp, Artificial
  Synthetic
ccccccccccgtcgaatacatttcatttctgatttcaattcaaaccaaaaaccctaggtcaaagttctgtgtgaaaatgtctggccgtggaaagggtggcaagggattgggcaagggaggagctaagaggcaccggaaggtgctaagggataacatccagggaattacgaagccagcaattcgtcggttggctcgtaggggaggagtgaagcgtatatctggtctgatctacgaagagacacgtggagtgatgaagatctttctagagaatgtgatccgtgatgctgttacctacaccgagcacgccaggagaaagactgttactgctatggatgttgtttacgcactcaagaggcagggcaggactctctatggatttggtggttaggttgtttagtttgtgatttaggttggtgtacttgtggtaattgtagattttctggaaatttctgttgtttcggtgttggtttctcagcagctttgttctagttgtcgttcttaaggtcttgatattgtaatttctcattgcaaattcaaggaacaaagttcattttctagaaattacaatggttaaattgattgtttgaaacgacca

SEQ ID NO: 1864 - DNA, 414 bp, Artificial
  Synthetic
gcagcatgtcaggccgaggaaagggaggaaaaggattaggaaagggaggagccaagagacatcggaaagtactcagagacaacatccaagggattaccaaacctgcgattcgtcgtctcgcgagaagaggaggcgtgaagcgtatcagtggtttgatctatgaagagactcgcggcgttctcaagatctttctcgagaacgtgattcgtgacgccgttacttacacggagcacgctcgccggaaaactgttacggcgatggacgtcgtttacgctctcaagagacaaggacgaactttgtatggattcggcggctaaatcgttcggattgcaatttcggattttgtaaactcttcaatttcagcatctagggatttcagatttgtaatttctcagttaaacgatgaatgaattg

SEQ ID NO: 1865 - DNA, 548 bp, Artificial
  Synthetic
gccattacggccggggatcgccctaatcattatctctcgcacaatttttcagcttcagggtctttaatttgcagagaaactaaaggttgattgaaaatgtctggacgtggaaagggaggaaagggattaggaaagggaggagcaaaacgacaccgtaaagtcctccgcgataacatccaaggtatcacaaagccagcaatccggcgtttggcacgtagaggaggagtgaagcgtatcagtggtctgatctacgaggagacacgtggcgtgctgaagatctttctagagaatgtgattcgtgatgctgtaacttacactgagcacgctaggaggaagactgtgactgctatggatgttgtgtacgcgctcaagaggcaaggccgtactctctatggttttggtggttagaatattggaattaattaatgttggttttacgtttaatgtaattatgttcttataagagtagttttggcaagaaacgttgttgcttaaattaatgaaattgcacactacatttttctcactattgatttgtcaatttgacc

SEQ ID NO: 1866 - DNA, 740 bp, Artificial
  Synthetic
tttggtaaaaaaccaggagacaagatatggagtaaattgttcatcctcattagattttcttagctttaagtttgcaaagattttcaactacaccgcattggctaacaacgacatcacaatagaaaacaaaagcagtagctaacactcctagatttactttagactaattcaaaccatttaacacagatctcagaaacaagaagaaatccccaaacttgcataaaccctaatcccccaaatcggattaacctccgaaaccgtagagagtacgaccttgcctcttcaaagcgtagacaacatccatggcggtcaccgtcttccttctagcgtgctcagtgtaagtaacggcgtcacggatgacattctcgaggaagatcttgaggacacctctggtctcttcgtagatgagaccactgatacgcttgacaccacctctacgagcaagacgacgaatggcaggcttggtgattccttgaatgttatccctcagaaccttcctgtgcctcttcgctcctccctttcccaatccttttcctccctttcctcttcccgacatcacttcacagttttacttgatacccaaagatctgtgactgtgaagaacagaagaaaaattattcagtgaatggtaacgaacagaaacgctagatttccaaatcaatcaattgaattgacgatcgaacaataaaccagatggagaagaagaagatacttttaagatgatttggcggacgcgtggg

SEQ ID NO: 1867 - DNA, 511 bp, Artificial
  Synthetic
gccattacggccggggatctcaaatcaaattctattttcttttcagttcaattactttaccaacaaaatgtcaggccgtggaaagggaggcaagggtttgggaaagggcggagcaaaacgacaccgaaaggttctccgtgataatattcagggaatcactaagccagctattcgtcgattggctcgtaggggtggagtgaagagaatcagcgggctgatttatgaagaaacaagaggagttctgaagatttttttggagaatgtgattcgtgatgctgtgacttacactgagcacgccagaagaaagactgttactgcaatggatgttgtttattcattgaagagacaaggcaggaccctctacggatttggtggttgatttatgtattttaggttttttaaggggaaatggagctcagttggtgtttaaaagttgtattgttaatgaaggttattaggtcattgtaacgagttatttgtgttaatgtaatggatctcattagtatttcag

SEQ ID NO: 1868 - DNA, 517 bp, Artificial
  Synthetic
gccattacggccggggatctcaaatcaaaattcatattcttctcagtttaattacgctacctacaaaatgtcaggccgtggaaagggaggcaagggtttgggaaaaggaggagctaaacgacaccgtaaggtgctccgtgataacattcagggaatcacaaagccagctattaggagattagcgagaagaggtggagtgaagagaatcagcgggctgatttatgaagagacaagaggagtgttgaagatatttttggagaatgtgattcgtgatgctgtgacttacacagagcatgctaggagaaagactgtgactgcaatggatgttgtttattctctcaagagacaaggcaggaccctttatggatttggtggttaatttatgtatttttatttgttttaggggagatggagtttagttggtgtttaattagtgtttgttgatgaatgttatgaggttgctgtaattgagttctttgtgttaatgaaatggatctcattactatttctgataaaa

SEQ ID NO: 1869 - DNA, 570 bp, Artificial
  Synthetic
cccccccccctgaaaccaaaaaaatccccaaatctcaaatcctcctccgtctccaagctctcgtcgtcgtcgtcagacatgtcgggccgtggcaagggaggcaaggggctgggcaagggaggcgcgaagaggcacaggaaggtgctgcgcgacaacatccaggggatcacgaagcccgcgatccggaggctggcgaggaggggcggcgtgaagcgcatctccgggctgatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctgattccttccttccttccttcctggtggcgtgcgggtggtggtggtggtgtaggagctagggtttcgatgggattcggggggaatttctgctttgtgttggcttctgtgtagcgactcttctgtttaaatgaattcgatgaatctgaactgaagatttggttcaaaaaaaacaaaaaaaaac

SEQ ID NO: 1870 - DNA, 587 bp, Artificial
  Synthetic
cccacgcgtccgcgatttcagggctccccaagtagtagacttctctcttcttccatctcggattcgtctcggtctccggcgatgtctgggcgcggcaagggaggcaaggggctgggcaagggcggggcgaagcgccaccgcaaggtgctccgcgacaacatccaggggatcaccaagccggcgatccggaggctggcgaggaggggcggcgtgaagcgcatctccgggctgatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggattcggcggctaggcgaggcgatgcgaggccacgcgattggatagggattcgattagtgccatgttcttcagttcgtcgtagtagcttagcctcttctcctgtagctgttgtttcatctcgtctcctgttccttcattaattagggatgtatgaactactggttcgttcgttcgaatggaataggaaatctgcagtgatttaccctc

SEQ ID NO: 1871 - DNA, 564 bp, Artificial
  Synthetic
cggacgcgtgggcaaagctcagtttctctcttttaaattcaatttctattttctctctctcaaactattgaaaaatgtctggacgtggcaagggaggtaagggattgggcaaaggaggagcaaagaggcacaggaaagtgctgagagataacatacagggaattacaaagccagctattcgtaggcttgctcgtaggggtggtgtgaagcgtatttctggtttgatttatgaggagacacgtggagtgcttaagatctttttggagaatgtcattcgtgatgctgtgacctacactgagcacgcaagaaggaagactgtaactgctatggatgttgtgtacgctctcaagaggcagggaaggaccttgtacggatttggaggttaaatattgggggttagggttcatagtattttgttgttagtgattgtggatttcatgtttgtgctttctggttgagctagtggtcagtttaaggtaggttagtttaatttctgttgttaaggtctggatattgtaattccgcgttatacaatcaagtaaaacagaccattttaccctattg

SEQ ID NO: 1872 - DNA, 521 bp, Artificial
  Synthetic
acatagacaagttagatttgaatttaagattgacagaaagatgtcgggcagaggcaaaggagggaagggtttgggaaagggaggggccaagcgacatcgcaaggtctttcgagataacatccagggcatcactaagcctgccattcgaaggcttgctcgtcgagggggtgtcaagcgtatctctggtttgatctatgaagaaacgagaggtgttctcaagatcttcctcgagaatgtcatcagagatgcagttacctacacagagcatgcgagaaggaagactgtcacggccatggatgttgtctatgccctcaagagacagggaaagaccctctacggttttgggggttgaactttcctttcttactttttggtcttctttacggtgtttgttaacaccactgcctttatgatctgagttacttttggcgaacttaatgtcatatacatgtctgttttatgtttcttgaacttgtagatgttttgaaaattagtaaagattggtgttgatttatggtgga

SEQ ID NO: 1873 - DNA, 690 bp, Artificial
  Synthetic
gggggctaagctctcagcaaccatgggtatctcacgagattctatgcacaagaggcgtgccactggtggcaagaagaaagcttggaggaagaagagaaagtatgaacttggccgccagcctgctaatactaagatctcggctaacaagacagtccgacgaattcgtgtgcgtggtggcaatgtgaagtggagggcactgagattggatacaggaaattattcatggggtagtgaggcagtcacacgcaagactcgtatccttgatgtggtttacaatgcatcaaacaatgaacttgttcgcacacaaactctggtcaagagtgctattgttcaagttgatgctgcgccatttaaacaatggtacctccagcattatggtgttgacattggtaggaagaagaagggccctgctaagaaggaaactactgaagaaggagaaggtgctgctgccgctgcagaggaaactaagaagagcaaccatgttctccggaagattgagacacgtcagaaggatcgtaaacttgatcctcatattgaagagcaatttggtggtggtaggctgttggcctgtatctcttctcgccctggtcaatgtggcagagcagatgggtacattttggagggaaaagagcttgagttctacatgaagaaactacagaagaagaaaggcaaggctggagctggtggtac

SEQ ID NO: 1874 - DNA, 653 bp, Artificial
  Synthetic
gggcggacgcgtgggcggacgcgtgggcttagctgcttttagctctcagcaaccatgggtatctcacgagattctatgcacaaaagacgtgccactggtggcaagaagaaagcttggaggaagaagcgaaagtacgagcttggccgtcaacctgggaatactaagatctcaagtaacaagacagtcagacgaattcgtgttcgtggtggcaatgtgaaatggagagcactgagattggatacaggaaactattcatggggtagtgaagcaaccacccgtaagactcgtatccttgatgtggtatacaatgcctcaaacaatgaacttgttcgcacacaaactctggtgaagagcgcaatcgttcaggttgatgcagcaccttttaaacagtggtacctccagcactacggtgttgacattggtaggaagaagaagggggctgctaagaaagaaactgccgaggagggagaaggtgctgctgctgcagaggaaactaagaagagcaaccatgtagcccgaaaacttgagaaacgccagaaggatcgcaaacttgatgctcaccttgaagaacaatttggtgcgggtaggctgttggcctgcatctcatctcggcccggtcagcgtggcagagctgatgggtatatcttggaggg

SEQ ID NO: 1875 - DNA, 650 bp, Artificial
  Synthetic
agcactccacgacaaccatgggtatttctcgagactcccgacacaagcgatcccacaccggcgccaagcgtgtctccatccacaagaagcgaaagttcgagtgcggtcgacagggtgccgtcacccgaatcggccccaagcgaatccacaccgtccgaacccgtggtggtaacaagaagttccgagccatccgaatcgagaccggcaacttctcctggggctctgagggaaccacccgaaagacccgagtcctcggtgtctctttccacccctccaacaacgagcttatccgaaccaacactctgaccaagtctgccattgtccagattgatgccactcctttccgacagtggtacgagtcctactacggcaagtctctcggcaagaagaaggctggccaggaggagcccgtcattgctgaggctgaccaggctgccgttgctgcccgacaggctgatgccaagctcgaccctgccgtcgaggctcagttcggtgctggccgactctacgcctgcgtttcttctcgacccggtcagtccggccgagttgacggttacgttctcgagggagaggagcttgctttctacctcaagaagattgtctccaagaagtagacacaaaactaaaatgtattattgcacgtgaaaaaa

SEQ ID NO: 1876 - DNA, 653 bp, Artificial
  Synthetic
acgcgtcggagggggtgaggctcgaagctactgcggctgccggaggaggaggaggacctgccacgccatgggtatctcacgagattcagtgcacaagaggagggccactggagggaagaagaaggcatggaggaagaagagaaagtacgagatgggccgtcagccagcgatgacaaagctgtcaagcaacaagacagtgcggaggatccgagtgcgtggtggtaacttcaagttcagggctttgcgtcttgacactggaaactactcctgggggtcagaggccaccacccgcaagtcgaggatcctggatgtggtctacaatgcctccaacaatgagcttgtcagaacccagactctggtcaaaagtgccattgtccaagttgatgcgacccctttcagacagtggtacagtcaacattatggcctggatattggccgcaaaaagaaatccagcagcgctgccaagaaggagactgaggagggtgatgctggagatgaggaaaagaagaaaagcaagcatgttctgcgaaagctaacaaagaggcaggaaggtcagaagcttgactctcatctagaggatcagtttgcaagtggtcgtctcttggcatgcatttcgtcccgcccgggacagtgtggccgagctgatgggtaca

SEQ ID NO: 1877 - DNA, 197 bp, Artificial
  Synthetic
gggcggacgcgtgggcggagcgaggaggaggcgccgcatcgtcgcggatcgatcagtcatgggtatctcccgcgattcgctccacaagaggagggctaccggtggtaagaagaagcaatggaggaagaagagaaaatacgagctggggaggcagccggcgatgaccaaactggcggccaagacggtgcggcgcattc

SEQ ID NO: 1878 - DNA, 614 bp, Artificial
  Synthetic
acagattgcaccaggagacccgacatcagcgtcttctgaacaaccgcaatcatgggtatctcacgagactctcgccacaagcgttccgcgtccggtgcgaagcgcgcatactaccgcaagaagagggctttcgagaagggccgccagcctgccaacacccgtattggcacaaagcgtgttcatcttgtccgcacccgtggcggcaaccgcaagttccgtgcccttcgtctcgaagccggtaacttctcctggggctccgagggcatcgccaagaagacccgtgtcatcggtgtcgtctaccacccctccaacaacgagctcgtccgtaccaacaccctgacccgctccgctatcgtccagatcgatgccgctcccttccgacaatggtacgaggcccactacggctcttcgctcggccgcaggaggcaggtcaaggccggtgagaaggaggaggacaagaagaagtccaactcggtcaccaagaagcaggccgaccgcttgaagaacggaggaaagattgagaacgctgttgagaagcagttcgaggccggtcgtctgtacgccgctgtctcttcccgtcccggccagagcggtcgctgcgacggctacgtcct

SEQ ID NO: 1879 - DNA, 610 bp, Artificial
  Synthetic
gcaggtgaggaggagaggagacccgccgccgccgccgccatgggtatctcgcgtgattccatgcacaagcgccgcgccacgggcggcaagcagaaggcatggcgcaaaaagcgaaagtatgagctcggaaggcagcctgccaacaccaagctgtcaagcaacaagacagtgaggagggtgcgtgtccgtggaggtaatgtgaaatggagggccctccgtttggatactggcaactactcatggggaagtgaggccgtgacccgcaagacccgtatccttgatgtggtctacaatgcatccaacaatgagcttgtcaggactcagacccttgtaaagagtgctattgtgcaagttgatgctgcccccttcaagcagtggtacctcactcactatggagtggatattggtagaaagaagaaggctcctgcagccaagaaggatgctgaggggcaggatgctgaagctaccacagaggaagcgaagaaaagcaaccatgttgtcaggaagcttgagaagcgccaacagggacgcacacttgacgcccacatcgaagaacagtttggcagtgggaggttgctggcctgcatttcttcccgccctgggcagtgtg

SEQ ID NO: 1880 - DNA, 690 bp, Artificial
  Synthetic
ccgctcccccccgctagttcccaaccagcagctgcggcggcgcgagcacacgaagaggaggcggagcagccggagccacctccgccgccgccgccaccatgggtatctcgcgtgactccatgcacaagcgccgggccaccggtgggaagcagaaagcgtggaggaagaagcgaaagtatgagcttggtcgccagccggcaaacaccaagttgtcgagcaacaagacagtgaggagggtccgtgttcgtggaggaaatctgaagtggagggctcttcgcctggatactggtaactattcttggggaagtgaggctgtcactcgcaagacccgtatccttgatgtggtctacaatgcgtcaaacaatgagcttgtgaggacccagacccttgtgaagagtgccattgtgcaagttgatgctgccccattcaagcagtggtatctcactcactatggtgtcgatatcggtaggaagaagaaagctcctgctgctaagaaggatgctgctgagggacaagagggtgaggctgccacggaggaagcaaaaaagagcaaccatgttgtgaggaagcttgaaaagcgtcagcaaactcgcactctggactcgcacattgaagagcaatttggcagcggaaggctcttggcctgcatctcctcccggcctgggcaatgtggcagagctgatgggtaca

SEQ ID NO: 1881 - DNA, 671 bp, Artificial
  Synthetic
ttttttgttgagccctccgtattgagctagccgtcggaaccctatgatccttcgtcgccggcaacaatgggtatctctcgggattcgatgcacaagagacgtgccactggaggcaagaagaaggcgtggaggaagaagagaaagtatgagcttggaagacagcctgcaaatacaaagctggtgcctaatgctaagactgttaggaggataagggtccgaggaggcaatgtgaagtggcgcgctttgaggttggacactgggaacttctcttggggcagtgaggctgttactaggaagactcgtttattggatgtggtgtacaatgcctcaaacaatgagctggttaggacacaaactctagtgaagagtgcaattgttcaagttgatgcagctccatttaagcagtggtatctccagcactatggagttgatattggtcgcaagaagaagagtgctgtcaagaaggaaggagaggaggctgagactgctcctgctgcggaggaaaagaaaagcaaccatgtgcagagaaagctgcaaaagcgtcaacaagatcgtaagattgacccacatgttgaagagcaatttgctagtggccgtctattggctgcaatctcgtcacgacctggccaatgtggtcgtgctgatggttacatcttggagggtaaggaact

SEQ ID NO: 1882 - DNA, 676 bp, Artificial
  Synthetic
gtcagctgcaaacatgggtatctcaagagattctatgcacaagagacgtgccactggtggaaagaagaaagcttggaggaagaagcgaaagtacgaacttggacgccaaccagctaatactaagatctcaagcaacaagacagttagacgaattcgtgttcgtggtggtaatgtgaagtggagggcactgagattggatactggaaactattcatggggtagtgaggcaaccacacgcaagactcgtatccttgatgtggtttacaatgcctcgaataatgaacttgtccgcacacaaacactggtcaagagtgcaattgttcaagttgatgctgcaccgtttaaacagtggtacctccagcattatggtgttgacattggtaggaaaaagaagggagctgctaagaaggaaactactgaggagggagaagctgctgctccagctgaggaagctaagaagagcaaccatgtagcccggaaacttgagaaacgtcagaaggatcgtaaacttgatcctcacctcgaagagcaatttggttctggtaggctatatgcctgcatctcatctcgccctggtcaatgtggcagagctgatgggtacattttggaagggaaagagttggaattctatatgaagaaacttcaaaagaagaaaggcaaggctggatctggtgct

SEQ ID NO: 1883 - DNA, 603 bp, Artificial
  Synthetic
cgctctcctcccccccgctagttcccaacgagcagctgcggcggcgcgagcacacgaagaggaggcggagcagccggagccacctccgccgccgccgccaccatgggtatctcgcgtgactccatgcacaagcgccgggccaccggtgggaagcagaaagcgtggaggaagaagcgaaagtatgagcttggtcgccagccggcaaacaccaagttgtcgagcaacaagacagtgaggagggtccgtgttcgtggaggaaatctgaagtggagggctcttcgcctggatactggtaactattcttggggaagtgaggctgtcactcgcaagacccgtatccttgatgtggtctacaatgcgtcaaacaatgagcttgtgaggacccagacccttgtgaagagtgccattgtgcaagttgatgctgccccattcaagcagtggtatctcactcactatggtgtcgatatcggtaggaagaagaaagctcctgctgctaagaaggatgctgctgagggacaagagggtgaggctgccacggaggaagcaaaaaagagcaaccatgttgtgaggaagcttgaaaagcgtcagcaaactcgcactctg

SEQ ID NO: 1884 - DNA, 637 bp, Artificial
  Synthetic
  misc_feature (473)..(473): The residue at this position can be any nucleotide.
gaattcatcaggcaacgcagtcgagaggtttctggttccatctgcaaacatgggtatctctcgtgattctatgcacaaaagacgtgcaactggaggaaagaagaaggcttggaggaagaagcgaaagtacgagctcggaagacagcccgcaaacaccaaactttcgagcaacaaaactgttcgaagagttagggttcgtggaggaaacgtgaaatggagagctcttagactcgatacaggaaatttctcatggggaagtgagactgtgaccaggaaatcccgtcttcttgatgtcgtttacaacgcatctaacaacgagttggttaggactcagactttggtcaagggtgctattgttcaagttgatgctgctccatttaagcaatggtatcttcaacattatggtcttgatattggacgtaagaagaagactactgctgccaagaaagaaggagaggaggctgaggctgtanctgaggaagcaaagaagagcaaccatctcctgaggaaaattgagggtcgtcaagtagatcacaagcttgactcacatattgaagagcaattcagtggtggacgattattggcttgtatctcatctcgccctgggcagtgtggtcgtgctgatggatacattctg

SEQ ID NO: 1885 - DNA, 612 bp, Artificial
  Synthetic
gaattcgggcgcgctacaggaggaaagaaaaagggatggaggaagaagcgaaagtacgagctcggtcgtcagcctgctaacaccaagctgtcaagcaacaagacagtgaggagagtacgtgttagaggaggtaatgtaaagtggagggcactccgattggatactggaaattactcatggggaagtgaaaccgttactcgtaagacccgtcttcttgatgtcgtttacaatgcatcgaacaatgagcttgtcaggacacagacattagtgaagagcgctattgttcaagttgatgctgctcctttcaagcaatggtaccttcagcactatggtcttgacatcggaaggaagaagaagactgctgctgccaagaaggaaaccactgaggagggagaagctgctgcagcagaagaagcaaagaagagtaaccatgtaatcaggaaagttgagaagcgtcaggtggatcacaaacttgaccctcatattgaagagcagtttagtggaggcagactattggcctgcatttcatctcgccctggacaatgtggtagagctgatgggtacatcttggaaggaaaggagcttgaattttacatgaagaagctacaaaag

SEQ ID NO: 1886 - DNA, 666 bp, Artificial
  Synthetic
gctttagggagggggtgaggctcgaagctactgcggctgccggaggaggaggaggacctgccacgccatgggtatctcacgagattcagtgcacaagaggagggccactggagggaagaagaaggcatggaggaagaagagaaagtacgagatgggccgtcagccagcgatgacaaagctgtcaagcaacaagacagtgcggaggatccgagtgcgtggtggtaacttcaagttcagggctttgcgtcttgacactggaaactactcctgggggtcagaggccaccacccgcaagtcgaggatcctggatgtggtctacaatgcctccaacaatgagcttgtcagaacccagactctggtcaaaagtgccattgtccaagttgatgcgacccctttcagacagtggtacagtcaacattatggcctggatattggccgcaaaaagaaatccagcagcgctgccaagaaggagactgaggagggtgatgctggagatgaggaaaagaagaaaagcaagcatgttctgcgaaagctaacaaagaggcaggaaggtcagaagcttgactctcatctagaggatcagtttgcaagtggtcgtctcttggcatgcatttcgtcccgcccgggacagtgtggccgagctgatgggtacattttggaaggaaa

SEQ ID NO: 1887 - DNA, 277 bp, Artificial
  Synthetic
tggtatcaacgcagagtggccattacgccggggcggctaagctctcagcaaccatgggtatctcacgagattctatgcacaagaggcgtgccactggtggcaagaagaaagcttggaggaagaagcgaaagtatgaacttggccgccagcctgctaatactaagatctcggctaacaagacagtccgacgaattcgtgtgcgtggtggcaatgtgaagtggagggcactgagattggataccggaaattactcatggggtagtgaggcagtcacacg

SEQ ID NO: 1888 - DNA, 651 bp, Artificial
  Synthetic
  misc_feature (587)..(587): The residue at this position can be any nucleotide.
gaggttgaggtcgctactcggagcagggccaagatgggtatctctcgtgattcggtacataaaaggcgcgcaactggagggaagaagaaagcatggcgcaagaagagaaagtacgaaatgggaaggcaacctgccatgacaaaactctcaagcaacaaaactgtccgaaggatcagagttcgaggagggaatttcaagttcagggcattgaggctggacacaggaaattactcttggggatctgaggcagccactcgcaaatcaagaatccttgatgttgtctacaatgcctcaaacaatgagctagtgcgaactcaaacccttgtgaaaagtgccatagtacaggttgatgctactcctttcaggcagtggtacaagcaacactatggattggacataggaagaaagaagaaagcttctggaggaaagaaagaagaggatgtagaggcaggggaagaagagaaaaaaataagtaaccatgtgcagcgcaaagttgctaaaagggttgaaggcaataaattagattctcacttagaagaccaatttgcaagtggccgtttattagcctgcatctcatctaggcctgngcagtgtgggcgggctgatggatatatccttgaaggaaaggaacttgagttctatcagaaaaag

SEQ ID NO: 1889 - DNA, 515 bp, Artificial
  Synthetic
cccccccccgcttccttcttcttccacgccgggcatcgccgccgccgccgccgccgccggagagggagagagagagagagagatcgagagcaagagatgaaaacgatcttggcttcggagacgatggagatcccgtcgggggtgacggtgcacgtggcggcgaaggtggtgacggtggagggtccccgtgggaagctgacgcgcaacttcaagcacctgaacctggacttccagctgctggaggtggagggggtgaggaagctgcaggtggacgcgtggttcggcacccgccgcaccatggccgccatccgcaccgccatctcccacgtccagaacctcatcaccggcgtcaccaagggctaccgctacaagatgcgcttcgtctatgcccatttccccatcaacgcctccatcaccaactccaacaccgccatcgagatcaggaacttcctcggcgagaagaaggtgaggaaagtggacatgcttgagggtgtgacaattttgcgttctgagaa

SEQ ID NO: 1890 - DNA, 685 bp, Artificial
  Synthetic
aattcgtgatcgcggaagggacgactccagataccctcaacgccccgacaacccccaagtcacagcagccatgaggtacattcactctcaggagatcctggaaattccagagggcgtcaaggtcaacatcaagacccgtatcgtcaccgttgagggtccccgaggcaagctcaccaagaacctcggtcacttggctgtcaacttcggtcaccccaagaagaacaccatctccatcgagatccaccacggcaaccgtaagaatgtcgccactctccgtaccgtccgctccatcatcgagaacttgatcaccggtgtcaccaagggcttcaagtacaagatgcgatacgtctacgcccattttcccatcaacgtcaacctggacaagaacaaggagaccggtctgttcgaggtggagatccgaaacttcatcggcgagaagatcgtccgacgggttaccatgcacgagggtgtcgatgttgagatctccaaggcccagaaggatgagctcatcctgaccggcaactcactcgagaacgtttcccagagcgccgcagatatccagcagatctgccgggtgcgcaacaaggatatccgaaagttcttggacggtctgtacgtttccgagaagggcaacgttgttgaggaggcttaaatgtaccggacaaggatctctgtttcttttgcg

SEQ ID NO: 1891 - DNA, 720 bp, Artificial
  Synthetic
gctgctagggttttagcgatcgccattttcacacacacagaaggagagcggaagagagaaactaagacaagatgaagaccattctgtcatcagaaaccatggatatccccgacggcgtgagcatcaaggtgaaggcaaagcaaatcgaagtagagggaccaaggggcaaacttgtccgaaacttcaagcatctcaacctcgattttcagctgatcaaggatgaggaaactggcaagaagaaactgaagatcgacgcttggtttggttctcgtaagactaccgctgctatccgtactgctcttagccatgttgagaatctcatcactggtgttacgaaaggttaccgctacaagatgcgtttcgtgtatgctcactttcccatcaatgcctccatcaccggtggtaacaagtccattgagatccgtaacttccttggcgagaagagggttaggaaagtggacatgcttgatggggttacagttgttcgatctgagaaggtgaaggatgagcttgtattggatggaaatgacattgagctcgtttctcgctctgctgccctcatcaatcaaaaatgccatgtgaagaacaaggatatccgaaagtttcttgatggtatctatgtcagtgagaagggcagaattgcagaagaagaatgagcagctgttttagaagtaggcatatcactgatgattcatatccagaatgccctttttacttttc

SEQ ID NO: 1892 - DNA, 548 bp, Artificial
  Synthetic
gcaatgaagtcatccagtccgacgttctgctcgatatccccgagggtgtcaccgttgacatcaaggcccgacgaatcaccgtcaccggcccccgaggtaccctcaagaagaacctgtctcacatcaacgttgccttcgagaaggtctccgatgaccagatcaagatcaccatcttcgatggtgaccgaaagcacgtcgctgctctgcgaaccgtcaagaccctcatcaacaacatgatcaccggtgtcacccgaggttacaagtacaagatgcgatacgtctacgcccatttccccatcaacgtcaacctcattaaggacggttccgtcgttgagatccgaaacttcctcggtgagaagcgagtccgagaagtccccatccacgagggctgcagcgctgagatctctaccaaccagaaggatgagatctgcatcatcggtaactccatcgagaacgtctctcagacctgtgctgacatccagcagatctggcgagtccgacacaaggatatccgaaagttccttgatggtatctacgtttccgagaat

SEQ ID NO: 1893 - DNA, 625 bp, Artificial
  Synthetic
gggtgcgaggaggaggaggcgggcgcgatgaagacgatcttgtcggcccagacgatggacatccccgagggggtgaaggtagagatccgggcgaagcagatccgggtgacggggccgcggggggtgctgcacaggaatttcaagcacctcaacctcgacttccagctgctggagaatgggcgcaagctcaaggtggaggcgtggtttgggtcgcgcaagaccatcgccgccatccgcaccgccgtgagccacgtgaagaacctcatcaccggcgtcaccaagggcttccagtacaagatgaggtttgtctacgctcacttccccatcaacgccaacatctctgccaccaagcaaaacatcgagatccggaacttcctcggcgagaagagggtgagaactgtcgacatgcttccgggtgtgactgtgaccaggacggagaaggtcaaggacgagcttgttctcgaggggaatgacatcgagcttgtgtcgagatcggccgctctcatcaaccagaaatgccatgtcaagaacaaggatatcaggaagttcttggatggtatctacgtgagcgagaagggaacgatcgctgtggaggagtagacctgttgcctgttctgagtataat

SEQ ID NO: 1894 - DNA, 626 bp, Artificial
  Synthetic
ggattaatcgcaactccgagatcctgctgaatcacaatgagacctactcaggttcgtctgggcggcggcgcccctcaacccaagactggccactggctcggtgactggggctcctttggtgagtgtgctctacttgacgaacgattgcatcagaccacccgcgaaagagactttgaggacgcaaggaaccggatggtggagggaagatgaggacgattcaatgggccgatatcttgattcagctggagcaattgaggcggaagacattgaacacgctacggagcaacaattggatcaggaattgcgtcgaaggacccgtcgggacgaactacaaagattgaaggagtcactcgcatgctaacatatgatgctataggtggtgccaagcagaagggcattatcgactacggcctgtctgccaaccgtcagaacccctttgccggtgctgcccacgatgccatcttcaacaccttccgccgcaccaagtcccagatcttctactggctccctcctatgctggctggctactacctgctgagctgggccaccgagcgaaaccactacctcaactccaaggctggccgtgctgagtttgccgactcggagtaaaatggtgcacgaatatg

SEQ ID NO: 1895 - DNA, 518 bp, Artificial
  Synthetic
gaaaaaggattaatcgcaactccgagatcctgctgaatcacaatgagacctactcaggttcgtctgggcggcggcgcccctcaacccaagactggccactggctcggtgactggggctcctttggtggtgccaagcagaagggcattatcgactacggcctgtctgccaaccgtcagaacccctttgccggtgctgcccacgatgccatcttcaacaccttccgccgcaccaagtcccagatcttctactggctccctcctatgctggctggctactacctgctgagctgggccaccgagcgaaaccactacctcaactccaaggctggccgtgctgagtttgccgactcggagtaaaatggtgcacgaatatgttgaattatgggtgtccaggggacacagtgtatatcagcgtctagattaggagaaaacaatagaaacgtttgactctacgagatatttgattctgttcttcgtcaagagattgatacactaatttgacgaaaacacaaaagaaa

SEQ ID NO: 1896 - DNA, 625 bp, Artificial
  Synthetic
aaacttaccgtctccccctttcgtccatttgtgatcgagtaggagagagagagagagagggaggaaagaggaagaagaagaggatggcgcctccagttgtagatgatgcctaccgcggagccatcgggaaggcccgccgtgacctccgcgccttcattgccgagaagaactgcgctcccatcatgctccgccttgcatggcacgatgctggtacctatgatgccaaaacaaaaactggtggtgcaaatggatcaatacgaaatgagaaggaacttctccatggggcaaatagtggtttgaaaatagccattgatttttgtgaaacactgaaggtgaagtatccagctatcacacatgctgacttttaccagctggctggtgttgttgcagttgaggttactggaggacccacagttgaattcattcctggtcgtaaggattccctggtttctccttcggaaggacgccttccagatgcaaataaaggtgcggcacatttgaaggatatattctatcgaatgggtctttcagacaaagatattgtagctctgtcaggggcacatacacttggaagagcacatgtacagaggtctggttttgaaggaccatggacacagcagcccct

SEQ ID NO: 1897 - DNA, 737 bp, Artificial
  Synthetic
gatcgaggcttgtgccctccacactcatttgtgctcgtcgtcgagaggagacgagaggcgagaggagaggacgcattcttggatctagatcgacaatcagaatgggcaaatcttatcctgcagtgagcgacgagtacctggccgccgtcgacaaggccaagagaaagcttcgcggcttcatcgcagagaagaactgtgccccattgatgcttcgtcttgcatggcattcggccgggactttcgactgtgcgtccaagacgggtggtccctttggaaccatgaagcacgccgaagaactcggccacggcgcgaatgccggcctcgacatcgctatcaagcttctccagccgattaaagaccagtttccggtcctgagctatggcgacttctaccagcttgctggggtcgtcgcagtggagatcactggaggcccggatattccattccatccggggagagtggacagggagacatgccccgtagagggccggcttccagacgcgaccaagggagccgatcatctccgtgacgtttttgtgaagcaaatggggctctctgacaaggacattgtggctctttctggcggtcacactttgggaagagcacacaaggaaaggtcgggttttgagggcccatggacgcacaaccctctccagtttgacaactcctacttcacacttctgctgagcggcgagcaagaaggcatcctgacgctcaagacggacaaggttctggtg

SEQ ID NO: 1898 - DNA, 400 bp, Artificial
  Synthetic
gagagagagagagggaggaaagaggaagaagaagaggatggcgcctccagttgtagatgatgcctaccgcggagccatcgggaaggcccgccgtgacctccgcgccttcattgccgagaagaactgcgctcccatcatgctccgccttgcatggcacgatgctggtacctatgatgccaaaacaaaaactggtggtgcaaatggatcaatacgacctgagcaggaacttctccatggggcaaatagtggtttgaaaatagccattgatttttgtgaaacactgaaggtgaagtatccagctatcacatatgctgacttttaccagctggctggtgtagttgcagttgaggttactggaggacccacagttgaattcattcctggtcgtaaggattccctg

SEQ ID NO: 1899 - DNA, 474 bp, Artificial
  Synthetic
gtgattttctgtcgacggtgaaggagctctctgtaaaaatcaaaggagggggttagccatggccaaggtgtatcctgctgtgagtgaagagtacaaagccgcagtagataaggcaaagaggaagctccgagcaatgatagcggagaagaactgtgcccccctcatggtcaggattgcctggcatagtgctggaacctatgatgtcaaaaccaagactggtggcccctttgggactatgaaaaatgcaagtgaactcgcccatggggccaatgcaggccttaataaggctgttgccctccttgaaccaatcaaggaacagtaccccattctatcctatgcagacttttatcagcttgctggagtagttgctgtggaggtaactggagggcctgacattcccttccaccctggaagagaggataaaactgagagcccagaggagggtcgtcttccagatgctaccaaagggccgag

SEQ ID NO: 1900 - DNA, 737 bp, Artificial
  Synthetic
gaggagagggagagaatgccggtgccggtggtggacaatgcgtacctcaaggcgatcgagtcggcgaggcgcgatctccgcgcgttcattgcggagaagaattccgcgccactgatgcttcggttggcatggcacgatgccgggacgtatgatgctgtgtccaagactggaggaccgaatggatcgatccggagcgagcgcgagtatacccacgctgccaacaatgggatcaaaatcgccatagacttttgtgagcctatcaaacagaaatatcccattatcacgtatgctgatctctaccagcttgctggcgttgttgctgtggaagtcactggaggtcctacaataaattttgttcctggccgcaaggaatcggtcgctactacacccgaaggacggcttcccgatgctcatcttggggcaaagcatatccgcgatgtcttctacagaatgggtctatctgacaaagatatcgtcgctctctctggtggtcacacactgggtagaggacacaaggaaaggtctgggtttgagggaccctggacatcacagccattgaagttcgacaactcatacttcacggagcttttgagaggagaatcggaaggcctgttgcagttgccgacagacaagtgcttgcttgaggatccatcgttccgtccatacgtggagctgtatgcaaaggacgaagacgcattcttcaaagattacgccgagtcgcacaagaagctatccga

SEQ ID NO: 1901 - DNA, 521 bp, Artificial
  Synthetic
atcaagatggcctcttccggccgtcagttcgcccgcgtggcaacccgcacaaccacccgctccttcgctgccgtcccccgacaggctttccgccagcagggtcgccgcttctactcttctgagcccgagaagaagtcatcctcctctctcctgtaccttggtgctgccgccgccgccggtggtctcggcatctggttcttcacctctggtgcctctgcctcttccaagacctttgtccccacccaggccgattaccagaaggtctacaacgacatcgccgagcgtctcgatgccgattatgatgatggcagctacggccccgtcctggtccgtcttgcatggcactgcagcggtacctacgacaaggagaccaaaactggtggcagtaacggtgctaccatgcgattcgctcccgagagcggccacggtgccaacgccggtctgattgctgctcgtgacttcctcgagcctatcaaggccaagtatccctggatcttcctactctgatctctggatcctcg

SEQ ID NO: 1902 - DNA, 626 bp, Artificial
  Synthetic
tagaactagtcacaccacacgcttggcttgacgccgcacgcctccgctccgctccgccgccgcggccgatctctctagggcttccaacctcgccggcgacgcgacgccacgccatggccgccccggtcgtggacgccgagtacctccgccaggtcgacagggcgcgccgccacctccgcgccctcatctcctccaagggatgcgcgcccatcatgctccgcctcgcatggcatgacgcgggcacttatgacgtgaacacaaaaactggtggtgcaaatggttcaattagatacgaggaagagtacactcacggttcaaatgctggtctaaagattgctattgatcttctcgagcctattaaagccaagagccctaagatcacatatgctgacctttatcagcttgctggagttgttgcagttgaagttactgggggtccaactgttgagttcattcctggaagacgtgattcgtcagtttgcccccgtgaagggcgtcttcctgatgctaagaaaggtgcactgcacttgagggacatcttttaccggatgggcttatcagacaaagatatagtagctttatctgggggtcacactctgggaagggcacatcctgaaaggtctgga

SEQ ID NO: 1903 - DNA, 627 bp, Artificial
  Synthetic
caagacacactctcaagatgcgatctttccgagcagtccgaaacttctccaccaccgccaagcgcctcagccaggcccccaaggcctccactcctaacgcctcctctggaaacggctttgtgttggcctttgtggcctccgccgctggagccggtgcctactactactacgccaactcccctgccgccaaggtcgagacctttaacgccaccaaggccgactaccagaaggtgtacgacgctattgccgacaagctgattgaggacgacgactatgatgatggatcttacggacccgtcctcctgcgactcgcctggcactcgtctggtacctacaacaagtctgataacaagtttggctcttccggaggtaccatgcgattcaagcccgaggcttctcatgctgccaacaatggcctggttaacgccagaaacttcctcaagcccatccacgagaagttcccttggatctccaccggtgatctgtacactcttggtggtgtcaccgccgtccaggagctcggtggccctatcatcccctggaagcgaggccgtgtcgacgagcccgagtctgcttctcctcccgatggatctcttcccgacgcctctcagggcgctactcatgtgc

SEQ ID NO: 1904 - DNA, 589 bp, Artificial
  Synthetic
cgagtactagtcacaccacacgcttggcttgacgccgcacgcctccgctccgctccgccgccgcggccgatctctctagggcttccaacctcgccggcgacgcgacgccacgccatggcagccccggtcgtggacgccgagtacctccgccaggtcgacagggcgcgccgccacctccgcgccctcatctcctccaagggatgcgcgcccatcatgctccgcctcgcatggcatgacgcgggcacttatgacgtgaacacaaaaactggtggtgcaaatggttcaattagatacgaggaagagtacactcacggttcaaatgctggtctaaagattgctattgatcttctcgagcctattaaagccaagagccctaagatcacatatgctgacctttatcagcttgctggagttgttgcagttgaagttactgggggtccaactgttgagttcattcctggaagacgtgattcgtcagtttgcccccgtgaagggcgtcttcctgatgctaagaaaggtgcactgcacttgagggacatcttttaccggatgggcttatcagacaaagatatagtagctttatctgggg

SEQ ID NO: 1905 - DNA, 690 bp, Artificial
  Synthetic
cccacgcgtccgcccacgcgtccgcttctccccttcttctcctcctcctcgattcggagctccacccgcagccatggcgaagaactaccccgtcgtgagcgccgagtaccaggaggccgtcgagaaggccaggcagaagctgcgcgccctcatcgccgagaagagctgcgcccctctcatgctccgcctcgcgtggcactcggcggggacgttcgacgtgtcgtcgaagaccgggggcccgttcgggacgatgaagaccccggcggagctgtcgcacgccgccaacgcggggctggacatcgcggtgcggatgctcgagcccatcaaggaggagatacccaccatctcctacgccgatttctaccagcttgccggagttgtggccgtcgaggtgtccggtggacctgccgtccccttccacccaggaagggaggacaaacctgcacccccacctgagggccgtcttcctgatgctaccaagggttctgaccacctaaggcaggtcttcggtgctcagatgggcttgagtgatcaggacattgttgccctctctggcggtcacaccctgggaaggtgccacaaggaaagatctggttttgagggaccttggacaagaaaccctctgcagtttgacaactcttacttcacggagcttctgagtggtgacaaggagggccttcttcagcttcc

SEQ ID NO: 1906 - DNA, 658 bp, Artificial
  Synthetic
ggtgaaggagctctctgtaaatcaaaggagggggttagccatggccaaggtgtatcctgctgtgagtgaagagtacaaagtcgcagtagacaaggcgaagaggaagctccgagcaatgatagcggagaagaactgtgcccccctcatggtcaggattgcctggcatagtgctggaacctatgatgtcaaaaccaagactggtggcccctttgggactatgaaaaatgcaagtgaactcgcccatggggccaatgcaggccttaataaggctgttgccctccttgaaccaatcaaggaacaataccccattctatcctatgcagacttttatcagcttgctggagtagttgctgtggaggtaactggagggcctgacattcccttccaccctggaagagaggataaaactgagagcccagaggagggtcgtcttccagatgctaccaaagggccgagtcacttgcgtgatgtgtttggtcacatgggcttgggagacaaggagattgttgccctctcaggagcccataccctgggtcgttgccacaaagatcgttctggatttgaagggccatggacgacaaatccccttttatttgacaactcctacttcactgaattgcttactggtgagaaggaaggactgatccagctcccttct

SEQ ID NO: 1907 - DNA, 838 bp, Artificial
  Synthetic
tggtatcaacgcagagtggccattacggccggggctcttgagatatgtactagtgtccattctcaccaagaaaccctagccccctaccgtgctcgagctgcttcgttgctaggttgccaattctatctccacaaccatggcggatgttgaagccgatgtgacggcagggcagccaaagaagaggacgttcaagaagtttagttacagaggcgtcgatctcgatgctttacttgacatgtccactgacgagcttgttaagctctttaatgctcgtcctcgcagaaggttccagagaggtttgaagaggaagccaatggccttgatcaagaagctgcgcaaggcgaaacgtgaggcaccaccaggggagaagccagagcctgtcaagactcatctgaggaacatgattattgttcctgagatgattggaagtgtcattggcatctacaatggaaagacgttcaatcagattgaggtcaaacctgagatgattggtcactatctggctgagttctcaatctcatacaagcctgtcaagcacgggaggcctggtattggtgctactcactcatccaggttcattcctctgaagtaatatgggatgtcaggttatttagtgccttcttttactagaattttgatgaaggccacagattatgaaagagttgagtcttaaattgcagtggtcagctgataaatatctatttttagttgtttgttatgaggttcgtttcttagacttttcttttcaaatgctcaatttaggagagggcttgatgctcacaagccatatgttcaagttccctcctgatgtcctagcactaagtcttttcttgatttc

SEQ ID NO: 1908 - DNA, 730 bp, Artificial
  Synthetic
ggatactccaacgaagctctctcccgtcgatcgaatcctcgctcttccgcagctatggcagatgttgaactggagcccggaacagtgcaacccaagaagaggacgtttaagaagttcacattccgcggtgttgatcttgatgccttgctggacatgtcatctgacgagcttgttgagctcttcaacgccagaatccggagaaggttccagcgtgggttgaaaaggaagtcagtggctctcataaagaagctgagaaaggcgaaactggatgcaccagcaggtgataaacctgaaccagtcagaactcatttgcgtaacatggtaattgtacctgagatgattgggagtgttattggtgtctacaacgggaaaacatttaatcaagttgaaatcaagcctgagatgattggtcattatttggctgagttttctatctcctacaagccagtgaagcacggccgtcctggtataggagctactcattcctctcggttcattcctctcaagtaatttggagctagtgatcgtctgccattggatctgcaattcttcattatgctgcagaaggagcagagaagtaggctggctaatatatatttaatgtttttctgagacaacctgacaattttgaaatgtagctgttcctccttattgcatcaagtagtgtgatgaattgtggtaggtagctggtaatgtgctagtatagcatgctcccttaactgtttttttt

SEQ ID NO: 1909 - DNA, 493 bp, Artificial
  Synthetic
aaacgacaaaaatggctgacgcttctgctgaatcccgaaaggctcgaaccttcaagaagttctcctaccgaggcgttgacctcaaggatctgctcgagatctccaccgacgagttcaaggagctcgtttccgcccgagcccgaagacggttcaaccgaggcctcaacaagaagcctaccattctcatcaacaagctgcgaaaggccaagctcgccgccggccccaacgagaagcccgccgtggtcaagacccacctgcgaaacatgctcatcttccccgagatgattggctctgttgttggtgtctacaacggaaagtccttcaccaccgttgagatcaagcccgagatgatcggcatgtacctcggtgagttctccatcacctacacccccacccgacacggccgacccggtgtctccaactccaagttcattcctctgcgataagggattgcatggtaataaaaatatgtattgtatgattgacatacgcg

SEQ ID NO: 1910 - DNA, 615 bp, Artificial
  Synthetic
attcgctcgtcgataccctgcgcgtcgataggcgaatccttggaatcaacacacaaccgcgatcatggctgacgaatacaacgccgaggaggccgctgagatcaagaagagaagaaccttccgcaagttctcttaccgaggaatcgaccttgacaacctcctcgacctctcctctgaccagctccgagatgtcgtccacgcccgtgcccgcagaaggatcaaccgcggcctgaagcgccgccccatgggcctcatcaagaagctccgaaaggccaagcaggaggccaagcccaacgagaagcccgacctcgtcaagacccacctccgagacatgattgtcgtccccgagatgattggaagcgtcattggtatctactccggcaaggagttcaaccaggtcgagatcaagcctgaaatggttggccactacctgggtgaattctctatctcatacaagcctgtcaagcacggtcgacctggtatcggtgccactcactcttctcgtttcattcccctcaaataagaaggttgtggtcttgggtggtttctgcattcacggacatttttgggcgaaaaggactggttttagtagacggaggaaagccgctactgaag

SEQ ID NO: 1911 - DNA, 636 bp, Artificial
  Synthetic
cgtcagcctccgcctccgcctccgcctccgccgccgccgccgagctcctcccgcgcgctccgagcccatcatggcggacgtcgaagtcgagacggaggtcgccgccggcgcacagccaaagaagaggacgttccgcaagtacagctaccgcggcgtcgacctcgacgcgctcctcgacatgtccaccgatgacctcgtccagctcttccccgcgcgcgcccgcagaaggttccagaggggtctgaagaggaagcccatggcgctcatcaagaagctgcgcaaggcgaaaaaggatgcccctgctggcgagaagccagagccagtgaggacccacctccgcaacatgatcattgtccctgagatgatcggaagcatcgtcggtgtctacaatggcaagaccttcaaccaggttgagattaagcctgagatgattggtcactaccttgcggagttctccatctcctacaagccggttaagcacggtaggcccggtattggtgccacccactcctctcggttcatccctctcaaatgagtcatgcagcttctagccatccagaatcagaattcagtgttaagcgcccatggcttgtccttccagtatcacttgttttttgagcaagttatatacctaag

SEQ ID NO: 1912 - DNA, 734 bp, Artificial
  Synthetic
cccgaaccgccgccgccgccgtctcctcctcctcatccaagcagctcgcgcctccgacccctcgcctcgagctccagctctccccaaccccttcaacaatggcggatgtcgaggtcgaggcggaggtggccgcggccggagcgccgaagaagaggacgttccgcaagtacagctaccgcggcgtggacctcgacgcgctcctcgacatgtccaccgacgacctcgtccagctcttccccgcgcgcgcccgcagaaggttccagaggggcctgaagaggaagcccatggcgctcatcaagaagctccgcaaggcgaaaaaggatgcacctgctggtgagaagccagagcctgtgaggacccacctcaggaacatgatcattgtgcctgagatgatcggaagcatcgtcggtgtctacaacggcaagaccttcaaccaggttgagatcaagcctgagatgattgggcactacctcgcagagttctccatctcgtacaagccagtcaagcacggtaggcctggtattggtgctacccactcctcacggtttatccctctcaagtgagagatcatctgcagctgtttgcgcttccagtatgtagcttgagctgtcgaacaaggaactccaaagtactttattaatagcgtgtccaccgagcagccactttttgaaccttggttaatctgatgttatttccccagatattttgaagttatatccaaacatgttatttct

SEQ ID NO: 1913 - DNA, 831 bp, Artificial
  Synthetic
cgaaccgccgccgccgccgtctcctcctcgtcatccaagcagctcgcgcctccgacccctcgcctcgagctccagctctccccaaccccttcaacaatggcggatgtcgaggtcgaggcggaggtggccgcggccggagcgccgaagaagaggacgttccgcaagtacagctaccgcggcgtggacctggacgcgctcctcgacatgtccaccgacgacctcgtccagctcttccccgcgcgcgcccgcagaaggttccagaggggcctgaagaggaagcccatggcgctcatcaagaagctccgcaaggcgaaaaaggatgcacctgctggtgagaagccagagcctgtgaggacccacctcaggaacatgatcattgtgcctgagatgatcggaagcatcgtcggtgtctacaacggcaagaccttcaaccaggttgagatcaagcctgagatgattggtcactaccttgcggagttctccatctcctacaagccggttaagcacggtaggcccggtattggtgccacccactcctctcggttcatccctctcaaatgagtcatgcagcttctagccatccagaatcagaattcagtgttaagcgcccatggcttgtccttccagtatcacttgttttttgagcaagttatatacctaaggcattttgttctgtttagataagcagcactgtgcacaatgatctgttttgccaagtttatgtgagaatcttgttaacgttgtcgtgatcgtattgttgattcttaattcttaaaatcctggtttggaattttcattaatctggtactcctaccagaatggattagcacc

SEQ ID NO: 1914 - DNA, 873 bp, Artificial
  Synthetic
aaatcacacgaaccctacacctgtccttatatatggctctcacgtctcggtaactcatcattcatcatctttccctcgaaaccctagccgcagtcacttccgtaggtgcttgcttaactgctagttcgattccaaaccatggcggacgttgaaggtgctgatgttgcggccggacagccaaagaagaggacgtttaagaagtttagctacagaggagtagatctggatgctcttcttgacatgtctacagatgagctcgtcaagctcttccctgctcgccctcgcagaaggttccagaggggcttgaagaggaagccaatggctttgatcaagaagctgcgtaaggcgaaacgtgaggctccaccaggtgagaagccagaggttgtcagaacacatttgaggaacatgattattgtacctgagatgattggaagtgttattggaatctacaatgggaaaacattcaatcaaattgaggtcaagcctgaaatgattagccactatttagctgagttctcaatctcatacaagcctgtcaagcacggtaggcccggtattggtgctactcactcttcaaggttcattccattgaagtagtctaaaaaaggttcattccattgaattgattcaggcagaggttttcgttatggtttctagtaatactagtactttattttactgcaattttgatgagaacaatggatgttgatctgtgattagtcttgagactagtattctgctgatacattgcagcagaccagttatttgtgcttatctagagggttgttccattttgattttaattatgtgttcagttagataattgaagtgttaaaagtcctactgacatccattactggatggtgttgccct

SEQ ID NO: 1915 - DNA, 679 bp, Artificial
  Synthetic
cctaccgaaccccgtctccgcctcccccgaaggtcgctgatttccatcttcacaaccatggcagacgttgaagccgatgtgacgagtggacagccaaagaagagaacgtttaagaagtttagctacagaggcgttgatctcgatgctcttctcgatatgtccactgatgagctcgtgaagctcttcaatgctcgtcctcgtagaaggtttcagagaggtttgaagaggaagccgatggcactgatcaagaagctgcggaaggctaaacgcgaggctccaccaggtgaaaagccagagcctgtcaagactcacctgaggaacatgattatcgttcctgaaatgattggaagtgttattggaatttataatggaaagactttcaatcagattgaggtcaagcctgagatgattggccactatttggcggagttctccatctcatataagcctgtcaagcatggtagacctggtattggtgctactcactcgtcaaggtttataccactcaagtgatctggccgagttctctatctcatataagcatatcaagcttggtagacctggtattggtgctactcactcgtcaaggtccatacaactcaagtgattttggcgccaatgtctacttttgcttctgttctagccttgtctgaactatttcgtacaacaattttgatgt

SEQ ID NO: 1916 - DNA, 660 bp, Artificial
  Synthetic
gaaagggaaggaggttttgctggaggccgaggaggaggaggagggaaggaaggaagaagaaggctgctttttttcgaagtcttacggcagctatggaaggtggagatgtggagcctgggacgcttcagcccaagaagagaacgttcaagaagttcaccttccgaggagtcgatcttgatgccttgcttgatatgtcctctgatgagcttgttgagcttttcaatgcccgaatccgaagaaggttccagcgaggattgaaaaggaaatctgtggctctgattaagaagctgagaaaggcgaaaattgatgcaccagctggtgataagcctgaacctgtgaggactcatttgcgcaacatggttattgtccctgagatgattggtagtgttattggtgtctacaatggcaagaccttcaaccaagttgaaatcaagcctgagatgattggtcactatcttggagaattttcgatctcctacaagccagtgaagcatggtcgccccggtattggagctacacattcatctcgtttcattcctctgaagtaaaccgagttgacgacggtgatgtatttattggtcctgcctccctgtcctttaataccggtttgggttgcttgccaatgaagtcacaatgcggctgacttatgccttatttgtt

SEQ ID NO: 1917 - DNA, 693 bp, Artificial
  Synthetic
gggccagggatagagaggaggagagtctgtcgttgtaccaggaggaggaggaggacgagtaggaggagtcctagggtttagtagaagacagcaaccatggtggccgcggagaagaagctgttgaaccccatgagggagatcaaggtgcagaagctcgtcctcaatatctccgttggtgagagtggtgatcgccttaccagggctgctaaggtgttggagcaattgagtggacagactcctgtcttctcgaaagctagatacactgtgcgttcattcggtatccgccgtaatgaaaagattgcatgctatgtgactgtcagaggagagaaggcaatgcaattgctagagagtggcttgaaagtcaaggaatacgagttgctgcgcaggaatttcagtgacactggttgctttggctttggaattcaggagcacattgatttgggaatcaagtatgacccatcgacaggtatctatggtatggatttctttgtagttctggagaggccaggattcagagttgcgaggagaaagagggcgcaggcacgcgttggcattcagcaaagggtaacgaaggaggatgccatgaagtggttccaagtcaaatatgaaggagtcattctcaacaagtcctccaacatcagttagttagttatctatctaactgcctgcaggctttgtaggacaaaattagtg

SEQ ID NO: 1918 - DNA, 682 bp, Artificial
  Synthetic
ctcgagcttgcggccgcctaatcttgagatggcatcggagaagaagctctcgaaccctatgagggatattaaggtccagaagctagttcttaacatctctgttggtgagagtggtgatcgtctcactcgtgcctccaaggtgttggaacagctcagtggtcagactcctgtcttctctaaggcgaggtacactgtgaggtctttcggtatcaggcgtaatgaaaagattgcgtgctatgtcaccgtgagaggtgagaaggcaatgcagcttcttgagagtggcttgaaagtgaaggaatacgagctgttgaggaggaacttcagtgacactggctgcttcggattcggtatccaggagcacattgatcttggaatcaagtatgatccttctaccggtatctacggtatggatttctacgttgttcttgaacgtccaggataccgtgtggcccgtcgccgtagatgcaagactcgcgttggtattcaacatagagttaccaaggatgatgccatgaagtggttccaagttaagtatgaaggagttatcctcaacaagtctcagaacatcactggttgaagagcttttttttgtcattttgttttgtttcaagttcttatatttaagattctggatagtaaggatttcgtgttgtggtaacctttttgcggccgcaagctcgag

SEQ ID NO: 1919 - DNA, 558 bp, Artificial
  Synthetic
ggggatattgaggaggagagtctgtcgttgtaccaggaggaggaggaggacgagtaggaggaggcctagggtttagtagaagacagcaaccatggtggccgcggagaagaagctgttgaaccccatgagggagatcaaggtgcagaagctcgtcctcaatatctccgttggtgagagtggtgatcgccttaccagggctgctaaggtgttggagcaattgagtggacagacccctgtcttctcgaaagctagatacactgtgcgttcattcggtatccgccgtaatgaaaagattgcatgctatgtgactgtcagaggagagaaggcaatgcaattgctagagagtggcttgaaagtcaaggaatacgagttgctgcgcaggaatttcagtgacactggttgctttggctttggaattcaggagcacattgatttgggaatcaagtatgacccatcgacaggtatctatggtatggatttctttgtagttctggagaggccaggattcagagttgcgaggagaaagagggcgcaggcacgtgttggcattcagcaaag

SEQ ID NO: 1920 - DNA, 649 bp, Artificial
  Synthetic
gggttggaggcgccgcggcatggcggaaaagcagaaccccatgcgggacatcaaggtccagaagctcgtcctcaacatctccgtcggcgagagcggcgatcgtctcaccagggccgccaaggtcctggagcagctcagcgggcagcaacctgtcttctccaaggcccggttcacggtccggtcttttggcatccggcgtaacgagaagatcgcttgctacgtgaccgttcggggcgacaaggcgatgcagctactcgagagcgggctcaaggtcaaggaatacgagctgctgcgccgcaacttcagtgacactggatgctttggcttcggcatccaggagcacatcgacctgggcatcaagtacgatccatcgacgggcatttacgggatggatttctacgtagtgctggagcggcctggctaccgcgtcgcgaggaggcggcggtgcaagtccaaggttgggatcaagcaccgggtgaccaaggaggacgccatgaagtggttccagctcaagtacgagggcgtcatcctcaacaagtcccaggccttctgacctgcttgacacataaaaaccaaagccggatgtaacctctcttgtggtgtgttttatatcagcttttttccaatgatctagaaagttttcggtcag

SEQ ID NO: 1921 - DNA, 732 bp, Artificial
  Synthetic
gatgcgggagatcaaggtgcagaagctcgtgctcaacatctccgtcggcgagagcggcgacaggctcacccgcgcctccaaggtgttggagcagctgagtgggcagagcccagttttctccaaggcgaggtacaccgtgaggtcattcggtatccgtcgtaacgagaagatcgcgtgctacgtcaccgtcaggggcgagaaggccatgcagcttttggagagtggcctcaaggtcaaggagtacgagctgctgaggaggaacttcagcgagaccggatgcttcgggttcggtatccaggagcacattgatcttggcatcaagtacgacccgtcaactggtatttatggcatggacttctatgttgttcttgagcgtgctggataccgtgttgctcgccggcgcaggtgcaagtcccgtgttggaatccagcacagggtgaccaaggaagatgccatgaagtggttccaggtcaagtatgagggtgtcatcctcaacaaggcccaagcaaacacgtcgtaattggcaagggtttaaccagttatcctgtagaattaagtgagggttcatttgaatcatggaactgtctttcttgaaagccaaatgcactgtcaattttgcctctgttggagttgacctgcgtctatatttccattaaatgcttaatgatatccttgttttaaatcttaatattaaggcagacttggaatcaatccacccgctttgttacctgg

SEQ ID NO: 1922 - DNA, 679 bp, Artificial
  Synthetic
gaatcgaaatggcttcagagaagaagttgagcaacccaatgagggaaatcaaggttcagaagttagtccttaacatctctgttggtgaaagcggagataggctcaccagagcagccaaggtcttggagcaactcagcggccaatcccctgttttctctaaggctaggtatactgtccggtccttcggaattaggcgtaatgagaagattgcttgctatgtcactgtcagaggagacaaagctatgcagctccttgagagtggattgaaagtcaaggaatacgagttgttgagaagaaacttcagtgagactggctgctttggttttggcattcaggagcacattgatcttggaatcaagtatgacccttcaaccggtatctatggtatggatttctatgttgtgcttgagcgcccaggataccgtgttgctcgtcgtaggaggtgcaaggcccgagttggaattcagcacagggtcacaaaggatgacgctatgaagtggttccaagtcaaatatgaaggtgttatccttaacaaatcctcaaacattcagtaagttgattgtggatcagtttgtcccccagcaagtttatgttttctatgcattttgtagaccaacatttaatactcctagagttcaaaggttttgaagagttgctgttatttggcatatcaggatat

SEQ ID NO: 1923 - DNA, 855 bp, Artificial
  Synthetic
ccccccccatctcattacccaacaactcttccagctactgctgctgttacatcttcctgcggtagcgccatggcttcagagaagaaattgagcaaccccatgagagaaattaaggtccagaagctcgttctcaatatctccgtcggtgagagcggagatcgtctcaccagagcagctaaggtcttggagcagcttagcggccaatcccctgttttctccaaggctaggtatactgtgcggtcttttggaatcaggcgtaatgaaaagatagcttgctatgtaactgtcagaggggagaaagctatgcagctacttgagagtggattgaaagttaaggaatacgagttgttgagaaggaacttcagtgagaccggctgctttgggtttggtattcaggagcacattgatcttggaattaaatatgatccgtcaactggtatttatggcatggacttctatgttgtattggagcgtcctggataccgtgttgcccgtcggcgcaggtgcaagtctcgagttgggattcagcacagagtcacaaaggaggatgcgatgaagtggttccaggtcaaatatgaaggtgttatccttaacaagtcctcaaacattcagtgataagcttagaaagccaacttctggatcagtctgtctcctcgcaagtttatgtttatgtattttgttgacctgcatctatatcactcgtagagggaagttttggagagtttctagtagtggcgtatgaggatgttttagttctcattttggctatcagatcaattcaatctttttttggtcattttcttttgttccaattaaatcagattcattgaactccacaatctagtacaatagatg

SEQ ID NO: 1924 - DNA, 509 bp, Artificial
  Synthetic
gcagtcgaacccgatgcgggagatcaaggtgcagaagctcgtgctcaacatctccgtcggcgacagcggggacaggctcacccgcgcctccaaggtgttggagcagctgattgggcagagcccagttctctccaaggcgaggtacaccgtgaggtcattcggtatccgtcgtaacgagaagatcgcgtgctacgtcaccgtcaggggtcgataatgccatgcagcttttggagagtggcctcaaggtcaatgagtacgatctgctgatgaggaacttcagctagaccggatgcttcgggttcggtatccaatagcacattgatcttggcatcaagtacgacccgtcaactggtatttatgggatggacttctatgttgttcttgagcgtgctggataccgtgttgctcgccggcgcaggtgcgagtcccgtgttggaatccagcacagggtgaccaatgaagatgccatgaagtggttccaggtcacgtatgagggtgtcatcctcaac

SEQ ID NO: 1925 - DNA, 404 bp, Artificial
  Synthetic
ctcgagcttgcggccgcaaaaaggttaccacaacacgaaatccttactatccagaatcttaaatataagaacttgaaacaaaacaaaatgacaaaaaaaagctcttcaaccagtgatgttctgagacttgttgaggataactccttcatacttaacttggaaccacttcatggcatcatccttggtaactctatgttgaataccaacgcgagtcttgcatctacggcgacgggccacacggtatcctggacgttcaagaacaacgtagaaatccataccgtagataccggtagaaggatcatacttgattccaagatcaatgtgctcctggataccgaatccgaagcagccagtgtcactgaagttcctcctcaacagctcgtattccttcactttcaagccac

SEQ ID NO: 1926 - DNA, 324 bp, Artificial
  Synthetic
ttacaaccatggctgacgtcgaggcactcaaggcaaaatacgttctccaaaccgccggctttgatgcccggttccccaacgctaaccagagcaagcactgcttccaaaactacctcgactaccacaagtgcatcaatgccaagggcgaggactttgccccctgcaagcagttctaccgtgcatatcgctcgctttgccccaacgattgggtctctcgctttgacgagcaaagggagaacggtaccttccctgcttccctcgaaccttgaatgtaaacactgtccatttgttacgaaccaaggccaataaaaatgtttctcacac

SEQ ID NO: 1927 - DNA, 760 bp, Artificial
  Synthetic
tcatccatcgtctttgattcatcaaacaggtaaacagccttgatagtccctttggcatcttctgcatctccggcttacacagtcaatccagctcttggatccgttctgatccagccaaccaaccatcgccatgtctgaacctctcaccaaggtcgactccgccgttcaaggcctgtcatcatcaccgcccaaagagaagggccataggagaacaagctctagcgcggctggtgttatgaccattgcggaaatcaatgaaagccatgctcctctagaactcgcaatagagacacagcagacagcgtggaaaataaatcagcggcccaaggatctcgacaatgatcagctgctacaggttcccctcaccaagcctcccatcaagagcataacattgaggttccctcatggcaaagaagtcgtggctcgcaacctgaagggcctgacaataggtgacgccctgtcggccattcacaaggcaaacaagaaccgagctgatgatgagcttgataatccatacctcaagggcttcgcatgggatcagggcgagaactactttgaagtacatctccagagccagccggcgacgggctcgtcaagcggcggtggcggtggcaagaagaagaagaagtccaaggacaatgacgagtaaatgaatatccacccatcctaatgtctgttcaatagttccttcaattgtttttttgtttggcttcgcctggttcgtgcgagtcggcgcccgggatattgcaactagatgttg

SEQ ID NO: 1928 - DNA, 736 bp, Artificial
  Synthetic
ttctctctgcataccaaaccacttcctccccccgcaagcaaacacagtcttttcagctctctctgggcttttatatacgcatagactcttccatcgttctttgtcaaattcatcctcctcttcaaccacaacaagccttcgttacaccgctttacgaagccccttcttctctcctctcctccattcttctaccttttccacacaacaaacacacacacagtcacaatggccttctctactcgaagcgtactgcgcgcctctcgcgccgtcaacttctcagctgcctcccgtgttgctgctcccagcaacgccgtccgcttcttctcggcctcccgtgccgtccgcgtgtctgacactgccaacaagaagagcgttgttcgcgagaaggaggttcccgtcaccgtctatggcgctggccagggtgacaagcagacactgcaggttcctgatggcgcctccaaggtcccctacgacagccccgtccccgctgagcgtgaggaggtcgagcctcttaacaagaaggtctacgaccagctgcctcacaccgtcaagagcatgacggttcaggacaaggtcatcatcatcactggtggtgctcgaggcctgggcaaccacatggcccgagcctgtgccgaggctggtgccaaggccatcatcatcttcgatgccaaccaggagctgggcgacgcttccgctgctgagctgcaccagaagtctggtctccccgtctccttct

SEQ ID NO: 1929 - DNA, 763 bp, Artificial
  Synthetic
atctagtcatctcacgacatttgactaacgactctatttattaacctgacggtgcaccccaacccagtaacacgttactaactaccccgtctctatcaccacgtgactctgaaccaaatctttggctttattttcacgttcccaacacaaaatccaaaccgccaatcaccccatctttttaatcagcaactctcccctcaacactacggttttcgaagtagttatttattcatatttataatgtcatactttgcatcagtccccgcagctcccgcagatgcccttttcggcctcatggccaagtacaaggccgataccttcgacaagaaggtcgacctcggagtcggagcctaccgagataacaccggaaaaccctgggtcctccctgtcgtctccaaggtcgattctctgattgtcgccgaccccactgccaaccacgagtacctccccatcactggtctgccagacttcaccaagtctgccgccaagctgattctggggcctgactctcctgccatcaaggagaaccgagttgcctcttgccagacaatctctggaactggagcaaaccatctgggatctctcttcctgtcgcggttcccctcctccgccgctccccccaagagcgtcttcctcagccgttctcccccttcccctggagcaaccggagatactcctccccgagctgctggcggccgaatctggatctccaaccccacctgggccaaccacaagcagatcttcgagaacgtcggtctgaccg

SEQ ID NO: 1930 - DNA, 699 bp, Artificial
  Synthetic
gatcagctatggagagcgtggcgctcaagcgagtttctgctgtagccaaccatctcaatcccgagcagcagcagcagcagcagcagcagcaactctccatggctgtcgccgccagcgccggcgcctcttcggtgtttgatcatctggagcaggcgcccgaggatcccattctgggaataactgtggcatacaacaaggaccctcatcccgggaaagtgaaccttggagtcggagcttaccgcacagaggaagggaaaccccttattttgcatgtggttcatcgtgctgaggaacgtcttctagctgatcgctccagaaacaaggaatacttgtcaatcactgggctggcagactttaacaagcgaagcgcgacgctcattcttgggagcgatagccctgctatcgtggagaagagattggtaactgcgcagtgcctttctggaacgggttccttgcgtgtaggagccgagtttctttcaagacattatggtgtgaagctggttttccttcctaccccgacgtggggaaatcacttcaaggttttcatgaatgctggacttggtgttaagacgtatcgttactatgacagcaaaactcgtggtcttgactatgagggtatgctcgaggacataagtgcagctccgaccggatcggttattctcttgcatgcatgtgctcataatcccactggcgtggatc

SEQ ID NO: 1931 - DNA, 583 bp, Artificial
  Synthetic
atcagctatggagagcgtggcgctcaagcgagtttctgctgtagccaaccatctcaatcccgagcagcagcagcagcagcagcagcaactctccatggctgtcgccgccagcgccggcgcctcttcggtgtttgatcatctggagcaggcgcccgaggatcccattctgggaataactgtggcatacaacaaggaccctcatcccgggaaagtgaaccttggagtcggagcttaccgcacagaggaagggaaaccccttattttgcatgtggttcatcgtgctgaggaacgtcttctagctgatcgccctgctatcgtggagaagagattggtaactgcgcagtgcctttctggaacgggttccttgcgtgtaggagccgagtttctttcaagacattatggtgtgaagctggttttccttcctaccccgacgtggggaaatcacttcaaggttttcatgaatgctggacttggtgttaagacgtatcgttactatgacagcaaaactcgtggtcttgactatgagggtatgctcgaggacataagtgcagctccgaccggatcggttattctcttgcatgca

SEQ ID NO: 1932 - DNA, 532 bp, Artificial
  Synthetic
tcccctcctcacaactccaccagactctcaaaacgatgctccgaaccatcgcccgaacccacgctgtggccgccaccaaggtcgtgcgagcctccactttttctgccacccccgccgcctcttttgtgcgattccagtccgtctgggccaaggtcccccagggtccccccgacgccattctcggaatcaccgaggcgttcaagaaggacgcctttgagcagaagatcaacctcggtgttggcgcctaccgagatgacggcggaaagcccttcgttcttccctccgtccgagaggccgagaaggaggtggtgaacaaggccctcgacaaggagtacgcccccatcaccggagtccccgccttcaccaaggctgctgccgagctcgcttacggcgccgactcccccgccgtcctcgaggaccgaattgccatcacccagaccatctccggtaccggtgctctgcgaatcggagccgagttcctcaacaagttctactcctccaagaagattctgctcccccagccttcttgggc

SEQ ID NO: 1933 - DNA, 687 bp, Artificial
  Synthetic
ggataggttgtttctcagctaggtcagaagccagaggtgaggcagaatgaagcacaacaacgtgatcccgaatgggcatttcaagaagcattggcagaactatgtcaagacgtggttcaaccagcctgccaggaagaagcgcagacgcgtcgcgaggcaaaagaaggctgtgaagatcttcccccgacctaccgggggacccctccggcccgttgtccactcacagactctgaggtacaacatgaaggttcgtgctggccgaggcttcactctggaggagctcaaggcagcaggcatttctagaaaactggctccaacaattggtgttgcagtagaccatcgaaggaagaatcgttgcctagaaagccttcaagtcaatgtgcagaggctcaacacatacaaggccaagcttgttgttttccctcgacgtgcacgaaagaccaaggctggtgactcttctcctgaggagcttgccaatgctacacagatccaaggatctgcccttcctattataaaggacaaggcggttgttgagcttgtgcctcttacagatgagctcaaggcccagaagggctacgccaagcttcgtgttgagaggatgaatacgcgaatgataggcatcagaaacaagagggctgccgaggcagagaaagatgagaaaaagtaggaagagcctgatttgagtat

SEQ ID NO: 1934 - DNA, 451 bp, Artificial
  Synthetic
agcaggtaggggaagcggaacacagcattgtcgctcccttgacggcaggctgcagtcttagcagcagcaatgaagcacaacaatgtgatcccgaacgggcatttcaagaagcactggcagaactacgtcaagacgtggttcaaccagccagcccggaagaagcgcagacgtctcgcgaggcagaagaaggcggtgaagatattcccgcggccaaccgcagggcccctccgcccggttgtccactcgcagaccctgcgctacaacatgaaggtccgcgctggacgtggtttcactttggaagagcttaaggcagctggtatttccaggaaactagctccgactattggtgtcgctgttgatcatcgaaggaaaaatcgctgtctagaaagcttgcaggccaatgtgcacaggctaaccacatacaaggctaagcttatcgttttcccacgtc

SEQ ID NO: 1935 - DNA, 740 bp, Artificial
  Synthetic
agtagctaaccaggtaagagatgaagcacaacaatgttatacctaatgggcacttcaagaagcattggcaaaactatgtaaggacttggttcaaccagccagctaggaaaacaaggagacgtgctgctagacagcagaaggctgtgaagatcttccctaggccgactgcaggatcacttcgacctattgttcatggacaaacactgaaatacaacatgaaagtccgggctgggaggggattttctcttgaagaactgaaagcagctggtattcccaagaaactagcaccaaccattggcattgctgttgatcatcgccgcaggaacagatcattggaaggtctccaaaccaatgtccagaggctcaagacttacaaagctaagcttgtcatcttcccaaggcgtgctaagaaagtcaaggctggtgattctagtgtagaggaacttgctactgccacccaggtccaaggttcttacatgcctattactagggagcagccagctgttgaacttgtcaaggtcacagatgagatgaaatcattcaatgcctatggcaagctgcgtatcgagcgtacaaatgcgcgacacatcggagccaggttgaagagggcagctgaagcagaaaaggaagaaaagaaataagcaattagaattgtcgtgtagcttgttaagcatgatcagttttctggtggactgagtgatgaagcttttgatacaatcatattcaggatcttgagcttt

SEQ ID NO: 1936 - DNA, 640 bp, Artificial
  Synthetic
tcgccccattgttcagtgccaaacacttaagtacaacatgaagtctagggctggaaggggcttcacccttgaagagctgaaggcagctgggatccccaagaagtttgccccaaccattggcatctcagtggatcaccgccgtaagaaccgctcacttgaaggtctgcaggccaatgtccagaggctgaagacctacaaggccaagcttgtcatcttcccaagacgtgctcgcaaggtcaaggctggtgactcgactcctgaggagcttgccacagccacccaggtccagggtgactacatgcctatcacccgtggcgagaagcgttcggttgaggtcgtgaaggtcacggatgacatgaaggcattcaaggcctacgccaagctgcgtgtggagaggatgaaccagcgccacatcggtgcccggcagaagagggcggccgaggctgagaaggaagagaagaagtgaaaggattgcaacctgcaacgttaagaatagatgccctaagttttattaccattattgttatcagcttctcctgatgcgagactagcattctgatcttgctgctgtctgtctactcttcagtttgagcttgtttgggtttctgtctgaagtgaaccaaactaagcgcatactact

SEQ ID NO: 1937 - DNA, 823 bp, Artificial
  Synthetic
gctccactcgttctgctcggtgtcctcgtcgtcgttgtcgtgtttaagtcatgaagcataacaatgttattccgaatggacacttcaagaaaaactggcagaactatgtgaagacctggttcaatcagccagcacgcaagaccaggagaagaattgcaaggcaaaagaaggctgtgaagattttccccagaccaaatgctggaactcttcgccctattgtccatggtcagacactcaaatacaacatgaaagttaggtctggtagaggattctcccttgaggagctcaaggctgcaggtatccctaagaaactggctccaacaattggtattgctgttgatcatcgtcgcaggaatcggtcacttgaggggcttcaaactaatgttcaaaggctgaagacatacaaggccaaattagtcgtcttcccaagacgtgctcgcaaggtcaaggctggtgattctgcccctgaggaattggctacggcaacacaagtccatggtgcttacatgcctattgcacgtgagaagccatcagttgatcttgtcaaggttactgaagagatgaagtcgttcaatgcctatggcaagctacgtgtggagcggacgaatgagcgtcacattggtgctaggatgaagagagctgcagaggctgagaaggaggaaaagaagtagtgaggcttatcttggttgatttacttgtcccatctttttgagtcctatttcgttaattaattacagaatttgctttgaactttttagctatagcattcaatgtcagctgggtgtatgattttcaacacttgttactttgttgatgagatttt

SEQ ID NO: 1938 - DNA, 486 bp, Artificial
  Synthetic
aagaaagctgcaacaatcttccctaggccaacagctggaccacttcgacctattgttcatggacaaacactaaaatacaacatgaaagtcagatctggcaggggattctccctagaagagctgaaagcagctggtattccaaaaaaacttgctccaactataggtattgctgtggatcataggcgcaggaacagatccttataaggtctccagaccaatgtccagaggctcaagacatacaaagctaagctagtcatcttcccaaggcatgctaaaatagtcaaggctggtgattctagtcccgaggaacttgccactgccactcaggtccagggtacttacatgcccattactagggagcagtccactattgagcttgtgaaggtcacagatgaaatgaaatcatttaatgcctatggcaagttgcgtattgagcgtacaaatgagcgtcatattggtgagaggttgaagagagcagctgaagca

SEQ ID NO: 1939 - DNA, 49 bp, Artificial
  Synthetic
gctaaaagaagctgggtttcgtaggcggcgggcagcggcgatggtgaag

SEQ ID NO: 1940 - DNA, 651 bp, Artificial
  Synthetic
cgtcgctcgacaaaaatggctatcggtaagaactaccccctcgtcaagaaccatttccgaaagaactggcaggagcgggtcaagacccactttgaccagcccggcaagaagtcttctcgacgacttgcacgaaccaagaaggccgctgctatcgctccccgacctctggatcttctccgacctattgtccgagcccccactatccgatacaaccgaaaggtccgagctggccgaggtttctctcttgaggagctcaaggctgccggtatcccccgagactacgctcgaaccattggtattgccgttgaccaccgacgacagaaccgatccgttgagggtcttgaggccaacgttctgcgactcaaggagtaccagtccaagctgattgtcttcccccgaaagctcaagaagggtgagaccaacgaggccaagtccgccgtccaggtcctctccacctctgctaccttccccattgtccagcaggctgccgagtccgagccccgagccatctctgccgaggccaaggagcagaacgcatacagaaccctccgaatggcccgatccacccagcgatacgccggaatccgagccaagcgagccaaggacgccgctgacgccgaggccgagaagaagacataagcaggttggcga

SEQ ID NO: 1941 - DNA, 671 bp, Artificial
  Synthetic
cccacgcgtccggaccacttcgccccattgttcagtgccaaacacttaagtacaacatgaagtctagggctggaaggggcttcacccttgaagagctgaaggcagctgggatccccaagaagtttgccccaaccattggcatctcagtggatcaccgccgtaagaaccgctcacttgaaggtctgcaggccaatgtccagaggctgaagacctacaaggccaagcttgtcatcttcccaagacgtgcccgcaaggtcaaggctggtgactcgactcctgaggagcttgccacagccacccaggtccagggtgactacatgcctatcacccgtggcgagaagcgctcggttgaggtcgtgaaggtcacggatgacatgaaggcattcaaggcctacgccaagctgcgcgtggagaggatgaaccagcgccacatcggtgcccggcagaagagggcggccgaggctgagaaggaagagaagaagtgaaaggattgcaacctgcaacgttaagaatagatgccctaagttttattaccattattgttatcagcttctcctgatgcgagactggcattctgatcttgctgctgtctgtctactcttcagtttgagcttgtttgggtttttgtctgaagtgaaccaaactaagtgcatactacttgtcttaagatg

SEQ ID NO: 1942 - DNA, 711 bp, Artificial
  Synthetic
gacccaagatgcttagaacaatcagatcccaatccatgcgaatggcctccgcctcgtcgcgaagaatgctgtcttccgccgcctccacatccatgctaagacaaacgctcaaggctccctccatgaccgctcaggtcactcgacccaccgtcatgaccttcaagcctgttctgctgtcccgaggatacgccgacgttgttgaggtgcctcccatggccgagtctctgactgagggtactctgaccgcctttgagaaggacattggagactttgtcgaggccgatgaggagatcgccaccatcgagaccgataagattgatgttgccgtcaacgctcccttcgccggaaccatcaccgagttcctggtcaagcccgacgacaccgtcactgtcggccagcctcttctcaagattgagcgaggcgagggctccagcagcggtggctccaagcctcccaaggagaagaaggaggagaagacggaggagaaggaggagcctgctcccaaggaggagtctgcccctgcccctaagaaggaggaggcccccaagaaggaggagtctgcccctgctcccaagaaggaggagaagaagcccgctcccaaggaggagaagaagaccgatgccaccgagggtctcggcggcttccgaaaggaggagcgagtcaagatgaaccgaatgcgacttcgaattgctgagcgactcaaggagtccc

SEQ ID NO: 1943 - DNA, 731 bp, Artificial
  Synthetic
gccttctaccactttgctctcctttcaaggcatcgcgaagactcttgtcaactctttttataatactctgactcttcgtccactctctgcttctgaaccacttcgactcatactacttgcacttgcatacactcgggactcttcccccgcctactctactcttctacacaaccaaccaccaacgcaatggctctcgacatgtggactcacgagttctgccttacttgcgaccgacaggtccaggtcgacggcgacgcctactgctctgaagcatgcagaatgtccgacttcgaaaagactccctctactcccagctcgcaggccagctcgcccggcttctctcccgtctcctacgctagatcaggcagcctctccagccgacctgctcccaccaagttcttcctgtctcccgcctacgacttcaaccaggcccagccctacggctcaactcctcggtcgtcatcgtcgtttggcagctacatgtcggacatgtcacctctctcctccaaccggggcctcaccccctcgagctcacacagcagcctctgctccatgcagagcgtatcctctaccgccgaggcgagccagctgtcagacaaggcacgcatggaactgcgagcatacgctgtttcattcgagcaggtcagactgcagcgccggcgatcatactaaataaacaacatcatcatcctacaaacaacacatacacacacataccacactctaccatc

SEQ ID NO: 1944 - DNA, 369 bp, Artificial
  Synthetic
gacacatacaaaaatggctaccaagtccggaatcgctattggacccaacaagggccacaaggtcactgcccgaacccccgccactcgagtttctcgacgaaagggtgccctctctaagcgatccgcttttgtccgagacctcgtaaaggaggttaccggccaggctccttacgagcgacgaatcattgagttgctgcgaaactccagtgataagcgagctcgaaagctcgctaagaagaagctcggtactttcggccgtgctaaggctaaggttgaggacatgaacaacgtcatcaccgcttctcgacacgcctaaattagctagcatatgtattaaaagtatggaaatacacccaaaaatgtttgatt

SEQ ID NO: 1945 - DNA, 687 bp, Artificial
  Synthetic
aaatttgattgaagccggagaaaatggcgatagggagcttagcaagacgaaaggccacaacaattttatcttctagatatctctatagcacatccaaatattcattttctcttaacagatattactcttcgggatctgatgaaaacgacgtcgttgttatcggcggtggacccggcggctatgtggcggcgattaaagctgcacagcttgggctcaaaactacttgtattgagaaacgtggtacccttggtggtacctgtctcaatgttggttgtattccttctaaggcacttcttcactcctcccacatgtaccatgaagctcaacattcatttgctagtcatggtgtgaagttctcttccgttgaggtagatcttcctgccatgatgggccaaaaagataaagctgtggctaacttaacacgaggtattgagggtctattcaagaagaacaaagtgaactatgttaagggctatggcaaattcctttctccttctgaagtttctgtcgacactgtggaaggtggtaatactgttgttaaggggaagaatattataattgccactggttctgatgtcaaaagtctacctgggctaactattgatgagaagagaattgtatcatccactggagctttagctttgaccgaagttccaaaaaagctggttgttattggtgctggctaca

SEQ ID NO: 1946 - DNA, 799 bp, Artificial
  Synthetic
caatctcggcaaatcttcatcatcgtcatttaaatattcgttttcagtttcaagaggttttgcttctggatcggctactgatgagaacgatgttgttatcattggaggtggtcctggtggttatgtagcagcgattaaggctgctcaattaggtcttaagaccacttgtattgaaaaacgtggtgctcttggtggtacttgtcttaatgttggttgtatcccttctaaggcccttttacactcctcccacatgtaccatgaagccaagcatgcatttgctaatcatggtgttaaggtttcaaacgtggaagttgatttgcctgcaatgcttggtcagaaagataaagcggtttccaatctcactcgaggtattgaaggcctcttcaagaaaaacaaggtaacatatgtcaagggttatggtaagcttatctctccatctgaggtctctgtcgaaaccattgaaggggaaaacactgttgtcaaaggtaaaaacattataattgcaacagggtcagatgtgaaacctcttccaggtatagctattgatgaaaagaggattgtttcatcaacgggagctctatctttatcagaaatccccaagaaacttgttgtcattggagcaggttatattggtctcgagttaggttccgtctggggcaggcttggatcagaggtgactgttgttgagtttgcgtctgacattgtcccctccatggatggtgagattcgcaagcaatttcagcgttcccttgaaaaacagaagatgaagttcatgctcaagactaaagtggtaggagta

SEQ ID NO: 1947 - DNA, 485 bp, Artificial
  Synthetic
cccacgcgtccgcccacgcgtccgacattcgttgtctgaacactaaaccaaaaaactccaaaaaaaacaacttaatacacacccccccaacaacacttaataccgacaagatgaaggccgctttcgttgctgttgctctcgccgctctggcccaggctcagacccgcgctgatatcccatcctgcgctctgccctgcctcgacgacgccgtcaaggccaacaccaagtgctccaccaccgactacgcctgtatctgcaaggacttcaacgctgttcagggcgctgccaccggctgtgtcgttgagaagtgcggtaccgacgttgccatcaacaaggtcctccccgccactcaggctctctgcgccgccaactctggatccggctctggctcttcttctgctgccaacaccactcccgcccagcagaccacctctgccgcccagtcttcttctgctgcccagtcttcctctgctgctcagtcctct

SEQ ID NO: 1948 - DNA, 579 bp, Artificial
  Synthetic
tttcacagtccagctacattcgttgtctgaacactaaaccaaaaaactccaaaaaaacaacttaatacacacccccccaacaacacttaataccgacaagatgaaggccgctttcgttgctgttgctctcgccgctctggcccaggctcagacccgcgctgatatcccatcctgcgctctgccctgcctcgacgacgccgtcaaggccaacaccaagtgctccaccaccgactacgcctgtatctgcaaggacttcaacgctgttcagggcgctgccaccggctgtgtcgttgagaagtgcggtaccgacgttgccatcaacaaggtcctccccgccactcaggctctctgcgccgccaactctggatccggctctggctcttcttctgctgccaacaccactcccgcccagaccacctctgctgcccagaccactcccgtcattcccgttggcactggcactggcgttccccccgctggcaacaagaccaccaccggtgctcccaccgcccctaccagcggcgcttccaccatcctggccggccttgccttcatcgccgctctctgcgcctttgccct

SEQ ID NO: 1949 - DNA, 562 bp, Artificial
  Synthetic
gctttcacagtccagctacattcgttgtctgaacactaaaccaaaaaactccaaaaaaacaacttaatacacacccccccaacaacacttaataccgacaagatgaaggccgctttcgttgctgttgctctcgccgctctggcccaggctcagacccgcgctgatatcccatcctgcgctctgccctgcctcgacgacgccgtcaaggccaacaccaagtgctccaccaccgactacgcctgtatctgcaaggacttcaacgctgttcagggcgctgccaccggctgtgtcgttgagaagtgcggtaccgacgttgccatcagtatgtttcccctggtcgatctgggatgaaatgagcttcgtctgtatactaaccaattccctacagacaaggtcctccccgccactcaggctctctgcgccgccaactctggatccggctctggctcttcttctgctgccaacaccactcccgcccagcagaccacctctgccgcccagtcttcttctgctgcccagtcttcctctgctgctcagtcctctgtcgccagcgctcccccca

SEQ ID NO: 1950 - DNA, 499 bp, Artificial
  Synthetic
cggacgcgtgggcggacgcgtgggcggacgcgtgggcggacgcgtgggcggacgcgtggggtcgagttccagccatctccgaaaatgactttcaagagaaggaacggaggtcgcaacaagcatggacgtggccacgtcaaattcgtccgttgctccaactgcggcaaatgctgccctaaggacaaagccatcaagaggtttcttgtgagaaatattgttgagcaagcagctgttagggatgtgcaggaagcttgtgcttttgaaacgtacactctgcctaagctgtatctgaagatgcaatattgtgtatcatgtgccatccactcaaaggtggttagggtccgctctcgaactgataggagggtccgtgagcctccacagcgattcaggcgcccaagggatgatgctccaaagcctggtcaagctccacgggttcctggagctgctccgacagcagcagctcgtacttgagtgcctgctgttttgatcatgttgttta

SEQ ID NO: 1951 - DNA, 633 bp, Artificial
  Synthetic
cccacgcgtccgcgccattagagttccatcgtattcactgctcagcagctgctacaactcgtccggccaaaatgacattcaagagaagaaacggaggtcgtaacaagcatggacgtggccacactaaattcattcgctgctctaactgcggcaagtgctgccctaaggacaaagcaatcaagaggttccttgtgaggaacatcgttgagcaagcagcagtgagggatgttcaggaagcttgtgcttttgaattgtacactcttcctaagctgtacttgaagatgcaatattgtgtctcatgtgccatccactccaaagttgttagggtccgctctgttactgataggagggtccgtgagcctccacagcgcttcagacgcccaagggatgatgctcccaagcctggtcaagctccacgccctgccggagctcctactgcagctcgttcttaagtgcctacattttgatcaactactgttaggcttttgggttttagttaatttgagatgtatttttgaagtcgatttctctatttagttttactggaactatcattaaatttgtgtatgcaaatctcaagcaaacaggcctgttgttcgtcctatagcttatatatcctttgcaattaaactc

SEQ ID NO: 1952 - DNA, 599 bp, Artificial
  Synthetic
atccacagctatgactgtgaagcggcggagccgtgggcgtagcaagcatgggcgtggccatgtcaatcccatccgatgctccaattgcggtcgctgctgccctaaggacaaggcagtgaagaggtttcttgttcgcaacattgttgagcaagctgcaattcgggatgtccaggaagcatgcgtttacgatggctatgttcttcccaagctatatactaagatacagcactgcatctcatgtgcaatccactcgcgcgtggtgcgtgttcgctcccgagaggctcggaggaacagggagccaccccaacgattccgccgaagggaggacactgctggaccaaaccgcccgcctgcacctccacgcccttgagcatagggcttacaattgaacatccttttaatctttagactcccaatatgcttattatagagtttctattttgtgattcacaaaggttgcgtgtcttttgaaaggctttgcaactaggaattttctttggtttagcaatgaggcaaagctcactctagttcaattttaagctatttcatgattactgctattttgttgccatgatgaatataaatattttcacttctct

SEQ ID NO: 1953 - DNA, 549 bp, Artificial
  Synthetic
ggaagaggtagaggactctttgtaggttttgcttgcagggtagaagactcttttactagggagctatgacggttaagcgtagaagtaggggacgaagtaagcatggccgtggtcatgttaatcccatccgatgctccaactgtggtcgatgctgccctaaggacaaagcagtgaagaggttccttgtccgcaacattgtcgagcaagcggcaatcagggatgtccaggaagcatgtgtttatgatggatatgttcttccaaagctttacacaaagatccaacattgcatctcttgcgctatccactcccgtgtagtacgtgtccgctccagagaggctcggaggaacagggagccaccacagcgtttccgtagaagggaggataatgccccaggacagaaccgtccccctccccctccccgcccttgagatttgtcaggcagttcattaatcctcgagacttagtgctttttaatatcttagttgcagcctatatgaagctcccactggggcccttatttttgtcttaaaaccaatttgtgctccaaac

SEQ ID NO: 1954 - DNA, 401 bp, Artificial
  Synthetic
gcaaagatggtcaagaagcgagcttccaacggacgaaacaagaagggtcgaggacacgttacctccatccgatgctctaactgtgcccgaatggtccccaaggacaaggccatcaagcgattcaccatccgaaacatggtcgaggccgcctccatccgagatctttccgaggcctccgtctaccaggagtacgtgctgcccaagctctacctcaagatccagtactgcgtgtcttgcgccatccactccaaggttgtccgagtccgatctcgagagggccgaaaggttcgaactcctccccagcgagtccgattcaacaaggacggtaagaagatcaaccctgctgccgccgccaaggttgtcgtttaggcgatgtataaaaaattgcactgtgtatgaag

SEQ ID NO: 1955 - DNA, 597 bp, Artificial
  Synthetic
actaggaagaggtagaggactctttgtaggtttttcttgcagggtagaagactcttttactagggagctatgacggttaagcgtagaagtaggggacgaagtaagcatggccgtggtcatgttaatcccatccgatgctccaactgtggtcgatgctgccctaaggacaaagcagtgaagaggttccttgtccgcaacattgtcgagcaagcggcaatcagggatgtccaggaagcatgtgtttatgatggatatgttcttccaaagctttacacaaagatccaacattgcatctcttgtgctatccactcccgtgtagtacgtgtccgctccagagaggctcggaggaacagggagccaccacagcgtttccgtagaagggaggataatgcccctggacagaaccgtccccctccccctccccgcccttgagatttgtcaggcagttcattaatcctcgagacttagtgctttttaatatcttagttgcagcctatatgaagctcccactggggcccttatttttgtcttaaaaccaatttgtgctccaaacttgtctgttttcagttataaatgaagttttttattatggataca

SEQ ID NO: 1956 - DNA, 82 bp, Artificial
  Synthetic
accatcaaacaacaatacaatccatacaggattacctctcaattcaaccacctttacgacaatcgcaactcaataaaatcct

SEQ ID NO: 1957 - DNA, 467 bp, Artificial
  Synthetic
ttaaaaacaacagaccgaaaaactcaagtcatcatgtcgcacccagagtcccccgaatttctccaggcgcagcaggccactgaggctttcaccacgaagcctaccaacgacgagctccttcgcctctacgctcttttcaagatcggcaagggcttcgatttggagtcggcccccaagcctggaatgttcgacatgaagaacaaggccaagtacaacgcgtggaaggccgctgtagaggaggagaacatcaccgaccccgaggaggcacagaagaagtatgttgagtttgtcgaggggctcaagtccaaatacgcctaatctcgacaagactcgaggattgaattagaagggggcacgctgcgagtgtaatacatggtactagagacgcatggcttttgggatagaatgccagttagcatgaagaaataaagtaaacaaattgtccacaaaaaaaaagaacagataac

SEQ ID NO: 1958 - DNA, 258 bp, Artificial
  Synthetic
cgccaaaaaagtcatctttaggcttcaaaagaggttggaaagctctctattcgcaacggctatcgctccgatcactggaatgctggggcgacaggtcatccttgacctcggcgtgggtcttggatccggattcatcatggccaaatggtattgggactgatagcacatgccgcgaagcacaggtctggacgcctactaggccgataaagaagccgaacgggccggcgcgggatcacagtaaggggggcacttgtatac

SEQ ID NO: 1959 - DNA, 668 bp, Artificial
  Synthetic
ccaaaccgccaaacaacgcatcttacggcttcacaacagcttggaaagctctctattcgcaatggctatcgcaccgatcactggagtacgtccctattccggccaatggcgcagcgtcgcactgggaatcgtggcaggtcctgctataaattcattggagtagctaacacaggatgcagatgctgcggcgacagctcatccttgacctcggcgttggtcttggatccggattcatcatggccaactggtactggtacggctaccacatgccccgaaccaacggccgagacgcctactacgccaagaaggaggccgaccgtgccgccgcggcatcacagtaaggggggcacttgtatactcgatggaccgagagggaatgcggcatgaacaactgctggtcgaatagaaggggaatgactgggccaacgggctgttcatgcctgcaggagcatagttgctggacagatgtcgaatatcactgaagaaaggcaaccgggcgaacctctacttagaccaataagtcgcggggcaatacgattcaattatctcgattggcttattatatgtttttgccatgccgactcccctttgtttattgctgaaaatagtgctggtggtttctttccaattatgtacaaattatgtgctatacgaagccaattctctga

SEQ ID NO: 1960 - DNA, 632 bp, Artificial
  Synthetic
aacaacgcatcttacggcttcacaacagcttggaaagctctctattcgcaatggctatcgcaccgatcactggagtacgtccctattccggccaatggcgcagcgtcgcactgggaatcgtggcaggtcctgctataaattcattggagtagctaacacaggatgcagatgctgcggcgacagctcatccttgacctcggcgttggtcttggtaaatattggcccccgactgtccgcagagctttggcacagctatgcggctatttgttttattatccgctttgactcacgtttcgttataggatccggattcatcatggccaactggtactggtacggctaccacatgccccgaaccaacggccgagacgcctactacgccaagaaggaggccgaccgtgccgccgcggcatcacagtaaggggggcacttgtatactcgatggaccgagagggaatgcggcatgaacaactgctggtcgaatagaaggggaatgactgggccaacgggctgttcatgcctgcaggagcatagttgctggacagatgtcgaatatcactgaagaaaggcaaccgggcgaacctctacttagaccaataagtcgcggggcaatacgattcaattatctcgat

SEQ ID NO: 1961 - DNA, 193 bp, Artificial
  Synthetic
accacgcgtccgggtttgggcagaggttgcccccaccccgccgtaaggtcccgtacgtgtgggtggttgatgggttgagtttggatagcaggaatctcagcttgggcagccgcctgcgtcgcaaatgcatgcaatctcaggcagtgggaatcgcatctgtgatgcaggtcctcaaagcagtcaatgttagccg

SEQ ID NO: 1962 - DNA, 705 bp, Artificial
  Synthetic
gaagcaaagcgtgtatcaacgctcctttctcgtctctctctctctctctcttctcttccgggctgctcctctttttctctctctctctttctccctctcttctcgcgacggaaggaaggcggaatactcctttctctttctctttctctctctcataccgaggtatttagggtttccacaggcggagagaagagagagagagagagagcgtctttcttcctctaccgctgctactactactgctacgaccatgtcggggatcgccaatgctaacctaccgcggcggatcatcaaggaaactcaacggttattgagcgagccagcccctggcataagtgcatcaccttctgaggataacttacggtatttcaatgttatgattcttggcccaactcaatctccctatgaaggcggggttttcaaattggaattgtttctacccgaagaatacccaatggcggctccaaaggtccgattcctgacaaaaatttatcatccgaatattgacaagctggggcgcatctgcctcgacattttgaaagacaagtggagccctgcactccaaattcggacagtccttctaagtattcaggcccttttgagtgcaccgaatcctgacgatccactttctgagaacattgcgaagcattggaagactaacgaggcagaagctatgcaaacagcaaaggagtggaccaggatgta

SEQ ID NO: 1963 - DNA, 748 bp, Artificial
  Synthetic
tggtatcaacgcagagtggccattacggccgggggttacataggaataagtaatatatttattgttttccccttcgtccaaactataggctcaaataccttatccaagctcagcagatctccgttttcacctaattcaatcaatcgcctcgcatcttctagggcttggatttgaaggtatacgagctaatctatggcgtcgaagcgtatattgaaggagctcaaggatttgcagaaggatcctccgacatcatgcagcgctggtccagttgctgaggatatgttccactggcaagcaactatcatgggtcctacggatagcccttatgcaggaggcgtatttttggtttcgattcatttccctcctgattatcctttcaagcctccaaaggttgcatttagaactaaggttttccaccccaacatcaatagcaatggaagtatatgtttggatattcttaaagaacagtggagtccagctttgaccatatccaaggtcttgttgtccatctgttctctgttgactgatccaaatccagacgatccacttgtaccagaaattgctcatatgtacaagactgacagggccaagtacgaggccactgctcgtagctggacacagaaatatgctatgggatgatgcggaaagtgtccttggacgtgcctgagacacttttaattgcaacagtttcattgtgctttcacccttaagtgcaatgtctttgtgcttggatgaaagtaaaatattg

SEQ ID NO: 1964 - DNA, 679 bp, Artificial
  Synthetic
cccacgcgtccgcccacgcgtccgcccacgcgtccgcccacgcgtccggctcagcatctctaggcttcagcactgcaatcttcgtctttctgcaaactcaattaatcccctctaccactctgccaccttcagatttgagcttgggtttgaaggtaaggaagtaacatatggcgtcaaagcgcatattgaaggagctgaaggatctgcagaaggaccctcccacgtcatgcagcgctggtcctgtggctgaggacatgttccattggcaagcaacaatcatgggccctacagatagcccttatgcagggggtgtattcttggtttctattcattttcctcctgattatccgttcaagccacctaaggttgcatttcgaactaaggttttccaccctaacatcaatagcaatggaagcatttgtctggatattcttaaagagcagtggagtccagcattgaccatatctaaggtcctgttgtccatctgctctctattgacagacccaaatccagacgatcctcttgtaccagaaattgctcatatgtacaagactgacaggtccaaatatgaggccactgctcgtagctggacacagaaatatgccatgggataatagcaaaagtgtcaccgggcatgtcagagactttgtagctgcaccgtcttaattgtgcttgggtg

SEQ ID NO: 1965 - DNA, 623 bp, Artificial
  Synthetic
atcgagtaggaggatctctgagggatatggcatccaagagaattctgaaagagctcaaggatctgcagaaagatcctcccacctcttgtagcgctggcccagttgctgaagatatgtttcactggcaagcaacacttatgggtccatctgacagtccttatgctggcggagtgtttcttgttaccattcattttccacctgattatccatttaagcctccaaaggtagcttttaggacaaaagtttttcacccaaacatcaacagcaatggtagcatttgcctcgacattttgaaggaacagtggagcccggcactcacaatatctaaggtgttgctgtccatctgttctcttctaacagacccaaatcctgatgatcctttggtgcctgagattgctcatatgtacaagactgataaaagcaagtacgaagccactgctcggagctggactcaaaaatatgccatgggttagttgctgaaacacaaatatttggcttttatctatgatgtattaagaaattgtgttatgcataattaactcaagggaaaggttgaattgtggccctctgtaaaacacttaattttcctcatgtttgtaagattaaatggttttgaaattctg

SEQ ID NO: 1966 - DNA, 510 bp, Artificial
  Synthetic
taagagtatctgcgttgaattgaagcgaaaggactttaaggaatggcatcctctgctcagcttcgattgatgtccgatctgaaggccattagccatgagccacctgagggatgcagtgccagcccttatagcgatgcggacctttttgtttgggacgccacaatatttggtcccgaagatactccatgggaatgtggcattttctgcctccgtttggtctttggagagcattaccctgccaaaccacctcgtgtcaggtttacttccgagatatttcaccccaatgtgtacaatgatggcaccttatgcatggacattatacaagatgcttggtctccttgccacaacatctgtacaattctaacatctgttcagtcattgctaacagatccgaatcccgcaagcccagctaactcggaagctgcacatttatatcaaactgatattcaagcatataacaggcgagttcggcgttgtgtgaggaagtctttggaaagcacatagtatact

SEQ ID NO: 1967 - DNA, 520 bp, Artificial
  Synthetic
  misc_feature (272)..(272): The residue at this position can be any nucleotide.
agagaagagtagagtagagtagtgaagagaggagagagcatgtctggaggaatagctcgaggtcgtctagcagaggagcgcaaagcatggcgcaagaatcaccctcatgggtttgtggcgaggcctgattctcaaccggatggttcaatgaacttgatgctttggcaatgcattatacctggaaaagttgggactgattgggaaggtggtttcttccctttggcaattcatttcagcgaagactatcccagcaagccacccaagtgcaaatntacccaagggtttttccatccgaatgtgtacccatctgggacagtgtgcctgtccatatggaatgaggattctggatggagacctgccataactgtcaaacaaatacttgtgggaattcaggaccttcttgattcaccgaatcctgcagatcctgcccaaagtgatgcatatcaactctatgttcaagatcccattgagtataaaaagaggattagacagcaatccaagcaatatcctccccctattt

SEQ ID NO: 1968 - DNA, 669 bp, Artificial
  Synthetic
gtacaaatgtcttctctctctctctctctctctctcgttcctttcgtttctttgccttccctataacggcggtggctatttaagaactccaagtagcagaagttatagttgaagagggatctggatctgaatctgaatctgtgtcatggctagcaagaggattttaaaggaactcaaggatctgcaaagggatcccccaacctctatgtagtgctggtcctattgcaaatgatatgttccattggcaagccactatcatgggtccctttgatagtccatatgctggaggagtttttctggttaccattcatttccccccagactacccatttaagcctcctaaggtgtccttcaaaaccaaagtcttccatccaaatgtcaatagtaatggaagcatttgccttgacatcttgaaggaacaatggagtcctgctctaacaatagcaaaggtcctactctcgatatgctctcttttgactgatcccaatcctgatgaccctctcgttccagaaatagcccacatgtataaaacagacagggcaaagtacgagacaactgcaaggagttggaccttgaagtatgctatgccctaaataaagctcacctcttgccttgcatatagttgaggtatatatattatatatatacacacacgttattacatatgca

SEQ ID NO: 1969 - DNA, 702 bp, Artificial
  Synthetic
cccacgcgtccgctcctcctcttcctccctcccgatcccctggcccgcacgaaactcaaagcatccccggcgccgcagctccccggaggaggaagcccccgcgccccgccccgaccagatccgatggccaacagcaacctcccccggcgaatcatcaaggagacgcagcgactcctcagcgagccagcgccgggaatcagcgcgtctccgtcggaggagaacatgcgctacttcaacgtcatgatccttggcccggcacagtccccctatgaaggtggagtttttaagcttgaactctttttacccgaggaatatcctatggctgctccaaaggttaggttcctgaccaaaatataccaccccaacattgacaagcttggtaggatatgccttgacattctcaaggacaaatggagcccagcccttcagattcggacagttcttttgagtatccaggcactcctaagtgcaccaaaccctgatgatcctctctctgataacattgcaaagcactggaaagccaatgaagcagaagctgttgaaacagcaaaggagtggactcgcctgtatgccagcggtgcataaaacccaatgcctctcgtgatgtaataacccgtcatgctttagccttaatcaaatgccatttgcttgataagaacaaactggagatattggcagtggaagggagtttaaatgactacc

SEQ ID NO: 1970 - DNA, 636 bp, Artificial
  Synthetic
cggacgcgtgggctgaattgcaacgtgtaggaggatctctgagggatttggtgaatcatggcatccaaacggattctcaaagagctcaaggatctccagaaagatcctcctacctcttgcagcgctggtccagttgctgaagacatgtttcattggcaagcaacaattatgggtccgcctgacagcccttatgctggcggagtgtttcttgttaccattcattttccacctgactatccatttaagccaccgaaggtagctttcaggacaaaggttttccacccaaacatcaacagcaatggtagcatttgcctcgacattttgaaggaacaatggagtccggcacttacaatctccaaggtattgctgtcaatctgttctctgttgacagaccctaatcctgatgatccattggtgccggagattgctcatatgtacaagactgataaaagcaagtacgaaacaactgcccggagctggactcaaaagtatgccatgggttagttgcagtgaccatctctggaggggctccttttcttctgtggtattctgtatatctattatgtattaagaaatggtgttcttatgcataatcaactcaaggggaaatgttgaacaggcccctgtaacaatttg

SEQ ID NO: 1971 - DNA, 361 bp, Artificial
  Synthetic
  misc_feature (234)..(234): The residue at this position can be any nucleotide.
agaatggctacttctgcgcagctccgcctcatgtcggacctcaaagccatcctcagcgagcctcccgagggatgcagcgcaagcccttacaatgatgataatctctttgtgtggaatgctactatctttggccctgaggacagcccttgggaaggtgggattttttctcttcgtttgatattcggagatcaatatcctgaaaagccacctcgtgttagatttactagcgagatnttccatccaaatggtgtacacaatggaaacttatgcatggatataattcaggatgcttggtctccctgccacaacatctgcactatattgacttcaatacagtctttattgacggatccaaatccag

SEQ ID NO: 1972 - DNA, 530 bp, Artificial
  Synthetic
ttcccatctctctctttctctctctctaggtatggcgtcgaaacggatacagaaggagctgcaggacctgcagaaggaccccccgacgtcatgcagtgccgggccggctggggaggacctcttccactggcaggccaccatcatgggcccctctgatagcccctacgacggcggcgtcttcttcatcaccattcacttcccccctgactaccccttcaagccccccaaagtcagcttccagaccaaggtttatcatccaaacatcagctcgaacgggagcatttgcttagacattctaaaggaacaatggagtccagcgttgacgatttcaaaggtgtggttatccatctgctctctgcttacggatccaaatccagatgaccctcttgtccctgagatcgctcacatctacaaaacccagaaggctcgctacgaggagaccggccgagcatggacccagaaatatgcaatgaactagttgaaaaatttccttacatatccttgcccacccttcaaactataataagcat

SEQ ID NO: 1973 - DNA, 653 bp, Artificial
  Synthetic
tctttctctcctatctctctcctctctctctctcatggcttccaaaaggattcagaaggagctgaaagacttgcagaaggacccccccacatcatgcagtgcaggtcctgttgcggaagatatgtttcactggcaggcaacaattatgggaccagatgacagtccttatagtggtggtgtgtttttggtgacgattcatttccccccagattatcccttcaagccccccaaggttgcttttaggaccaaggttttccacccaaacatcaacagcaatgggagcatttgcctggatatattaaaagagcaatggagtccagctctgacaatatctaaggtcttgctttcaatctgctcacttctcactgatccaaaccccgatgatcctctggtacctgagattgcacacatgtacaagatagacagagcaaaatatgaaggtattgcaaggagttggacacagaagtatgcaatgggttgagccttttttttcggcaaaagataacaacttttatcagtctatctcatatctaaaaagaatcggtttacaactttctgtttctgcatcttgttggtccaaagctcaaatcacacgtgtatctttactttcatagccaaggagttgatatagaagtagtgcaaggaacaggtac

SEQ ID NO: 1974 - DNA, 696 bp, Artificial
  Synthetic
aggaaaggagcgcatctcaaaagccccaagcctagggcctgtcttccccttggaacaaaagcaccccccacccatagccattagccattagccattatgtcagaaactcaggctagccttctccttggcaaacaacttagagagcttttaaaatctccagtggaaggtttctcagcagggctggtggatgattctaacctctttgaatggaatgtgaccattattggtcctcctgatacattatatgaaggtggtttcttcaatgccattatgagctttcccaaaaattatccaaatagtcctccaacagtcaggttcacctctgagatgtggcacccaaatgtgtatccggatggccgtgtttgtatttccattcttcatgccccgggggatgatccaaatggatacgaacatgctagcgagcggtggtcaccagtgcacacggtggaaaccattctattgagcatcattgcaatgctttccagtccgaacgacgagtctccggcaaatatagatgcagcaaaggaatggagagagaacagggcggagtttaagaagaaagtgcgtcgcattgtacggcgatctcaagagtgtctctgaatttggcaatataccagggtatgtatcctcattgagaaacccttgaaacttctctgaattgatagaaaaaaggaagggacatacatatatatcaga

SEQ ID NO: 1975 - DNA, 667 bp, Artificial
  Synthetic
ggtgcttacaggcgttagaagagaagacggagagagagagagagaagggaagtccaggcgtctctatctttcttactctgcccttctcagcattcccactgccatgtccacccctgcacggaagcgcttgatgcgtgacttcaagcggcttcaccatgatccccctgctggcataagtggtgctcctcaggacaacaacattatgctttggaatgctgtcatctttgggccggatgacacaccatgggatggaggtacgttcaagctgacattacaattttctgaggactatccaaataagcctccgacggtccgttttgtgtcgaggatgttccacccaaacatttatgccgatggaagtatctgcctggatattctgcagaaccaatggagcccaatctatgatgtcgcagcaatacttacatccattcagtctttgctctgcgatccaaacccgaactctccggcaaattccgaagcagcacgaatgtatagcgaaaaccggcgagactacaaccggaaagtgcgcgaaatagtggagcaaagctggacggctgaatgatggatgaactgtctacctctagtgatatacaagtgtgtcgaaacagttgcatgaggttgaactaattctctccttttacaagtttggcactttcgtaaaaattct

SEQ ID NO: 1976 - DNA, 597 bp, Artificial
  Synthetic
cccacgcgtccgcccacgcgtccgctcacctggcgcgccgaagcttctctcctctctctcaactccggcgagaggaggaggcggcggtggggcgttcgtcgggagagagaccagggccggggggctagggttcggccgttcagagaggcggcggctgaggaggaggaggaggaggaggagggggtgaggagagatgtcgacgccggcgaggaagcggctgatgcgggacttcaagcggctgcagcaggacccgcccgccggaatcagcggcgcgccgcacgacaacaacatcatgctctggaacgccgtcatattcggaccggatgacacgccgtgggatggaggcacgttcaagctgacactacaatttacagaagattatcccaacaaaccaccagttgttcggtttgtctcaaggatgtttcacccaaatatttatgcagatggaagtatctgcttggatatcctacaaaatcaatggagccctatatatgatgttgctgcgatattgacctctatccagtccctgctctgtgatccaaacccaaactcccctgcaaactccgaagcagccagactgttcagcgagaacaagcg

SEQ ID NO: 1977 - DNA, 613 bp, Artificial
  Synthetic
ctccacgcctccacaaataaagctcgtcccgaggaagggcggcgacccaccccctcccaatcgccaaaaccctaactccgatccgatcgagctctgcttcccatggcgactgccgcgagccaggcgagcctcctgctccagaagcagctcaaagatctcgcgaagaaccccgtggatgggttctcggcggggcttgtggacgatagcaacgtgttcgagtggcaggtcaccatcatcggcccgcccgataccctgtatgatggaggctacttcaatgcaataatgaccttcccccagaattatccgaatagtcccccatcagtaaggtttacctctgagatgtggcatccaaatgtttatcctgatgggcgcgtatgcatttctatccttcatccacctggtgaagatcccaacggttatgagcttgcgagcgaacggtggacacctgtgcatacagttgaaagtatagttctgagcatcatttcgatgctctctagtccaaatgatgagtctccagcaaatattgaagcggctaaggattggagagaaaagagggacgatttcaagaaaaaggttagacgcattgttcgtaaatcacaggaaatgctctgaa

SEQ ID NO: 1978 - DNA, 707 bp, Artificial
  Synthetic
gaattcagcagctaacaacaataccccaataccaaaccctaacccttaatctcccgcagctgtataaaaccctaatcattagatcctgagaagaatcggagttttttctcacagctttttcttacggctgtgaggatgtcgaccccttcgaggaagaggttgatgagagatttcaagagattgcaacaggatcctccagcaggcatcagcggtgcaccgcaggacaataacataatgctatggaatgctgttatatttggcccagatgatactccctgggatggaggtacctttaagttgtctctgcagttttcggaggactatccaaataagccaccaacagttcggtttgtttcgcggatgttccatccaaatatctatgcagatggaagtatttgcttggatatcttacagaatcagtggagtcctatttatgatgtagctgctattctaacttctatccagtcgttgctttgcgacccgaacccaaattctcctgctaattctgaagctgcaagaatgtttagtgataacaagcgtgactacaacagaaaagtacgcgaagtcgttgagcaaagctggacagcagattaactgctcatccctaacatgtggatgtcatttgacttattctgtaaagtttgaagtctacgtaagtaaacatttccacttgaaaacaattgtaatacagacataagagttatata

SEQ ID NO: 1979 - DNA, 599 bp, Artificial
  Synthetic
gaattcaaaaagactataaaatccaatcaacctctccaattcccggaatcctccttcctcctccggtttcttcctttttcagagcaccgagttcctctggatcctctctcctggtttcttcaaataccctttggtttttttcctttacccctcttgtaaaatctagggtttcgagagaaaaaaatcttcagagaggatggcctccaaacggatcttgaaagaactcaaggatcttcagaaagatcctcctacttcttgctccgcaggtcctgttgccgaagacatgtttcactggcaagcaacaataatgggtcccccagacagtccatacgcaggaggagtctttctagttactattcatttccctccagattatccattcaagccaccaaaggttgccttcaggacaaaggtattccaccctaatatcaacagcaatgggagcatctgtcttgacatcttgaaggagcaatggagccctgccttgaccatttccaaggtgttgctatccatttgctcattgttgacggacccaaacccagacgatcctttggtgccagagattgctcacatgtacaaaaccgacaggagcaagcatg

SEQ ID NO: 1980 - DNA, 761 bp, Artificial
  Synthetic
tgtttttagtgagacaaagagtgtgaaactctcttacaatttctactttctctctctagaaaaaaagagacccttagcgtaaattttctgcgatcaaaaaaagaattcgattcaattcaatggccaacagcaatcttcctcgaagaattattaaggaaactcaacgtcttctcagtgaacccgcgccgggaataagtgcctctccttcggaagaaaatatgcgatacttcaatgtcatgattcttggtccaacacaatctccttatgaaggaggtgttttcaaactggaactctttttgcctgaagagtacccaatggctgctccgaaggttcgatttctcaccaaaatataccatcccaacattgataagcttggtaggatatgccttgatattctcaaggacaagtggagtcctgctcttcagattcgcaccgttcttttgagcattcaagcacttctgagtgcaccaaatccagatgatccactctcagagaacattgcgaagcattggaagtcgaatgaggctgaagctgttgaaacggctaaagaatggacacgcctgtatgcaaccggtgcctgaaacggcatgactaagtgattttgaaaagaaaaagaaaaaagatgtggaatgtaatttatccactgtctaatcaggggacatgggaggactgaaagctaaattaccatctataatattttccctacccttgaaattgtatagtcaaatattgcacctttttattccaagttgaagaaactt

SEQ ID NO: 1981 - DNA, 713 bp, Artificial
  Synthetic
tacgaaaccaacaaggaagagaatcaaattcttctattcccaataattctctattcagattcgatctcggtctctgagtgatggcttcgaaacggatcttgaaggagctcaaggatctccagaaggatccccctacctcttgcagcgccggccccgtcggagaggacatgttccattggcaggccacaattatgggtcccccagacagcccttataccggtggtgtattcctagttactatacattttcctcctgattatccattcaaacctcctaaggttgcttttagaacaaaagttttccatccaaatattaacagtaatggcagtatatgcctggacatattgaaggagcagtggagccctgcattaactatttccaaggttttgctttcaatttgctctcttttgacggacccaaatcccgatgaccccctggtgccggagattgctcacatgtacaagacagacagagctaaatacgaatcaactgccaggagttggacccagaaatatgccatgggttagaacattacctatacgggcccgagtccatgtaaaaagaattcatgtgcctgttctctctcctctctcaaccagcaaagtgtagaatagcattaaatgttgtcctctccaagaaaaagagatgctttgaatatttttatatggattctaacattttaagaaatctgggaactgtttatttatctggtt

SEQ ID NO: 1982 - DNA, 794 bp, Artificial
  Synthetic
cccacgcgtccgcgcacggtgatattgagaatcgccgacctgaatcgatcggaaaactttctctgattaccggcggtcaacaccgctgaacacatatgtttgtttgacgacctcttctctccgcgatctttacctcaacaacgagatctgtttccacgaaagaaaggaggatgtcgacgccagcaaggaagaggttaatgagggatttcaagaggttgcagcaagacccacctgcgggtattagtggtgctccacaggacaacaacattatgctctggaatgctgtcatatttgggcctgatgacacaccatgggatggaggtactttcaaactctcactgcagttctctgaagattatcccaataaaccaccaacagttcggtttgtgtcacggatgtttcatcctaatatttatgcagatgggagtatctgcttggacattctacaaaaccagtggagtccaatctatgatgttgctgctatacttacctccatccagtccttgctctgtgaccctaatccgaattctcctgcaaactcggaagctgctcggatgtacagcgaaagcaagcgcgagtacaacaggagagtgcgtgatgttgttgagcaaagctggactgctgactagtagtagtttgttgtaagcgttgtagctctctctactttctctcaatcacgattcagcaacagctttcttctcttttcattcatgtcttgtgtttccaaaactatttaagtgattccatgctttgatgtaacccaacatccttaaaaaaacaactttgttccacac

SEQ ID NO: 1983 - DNA, 671 bp, Artificial
  Synthetic
cccacgcgtccgatctcttctattcataagttgtaaattcttattattgggattttttccctttttaattcaatccaagaattgagtaggactaatggcatccaggagaattcacaaggaactaagggagttgcaaagagaccctcctacttcatgcagtgcaggtccggtggcacaggatatgttccattggcaagcaaccattataggtccaaatgacagcccttatgcaggtggtgttttccaagtggccatccattttcctcctgattaccctttcaaacctcccaaggtggctttcaagaccaaagttttccatccaaatataaataataatggaaatatttgtttggacattcttaaggatcaatggagtcctgccctcaccatatcaaaggttttgctttccatatgttcactactaacagatccaaatccagatgatccattggttccagaaattgctcatatgtacaaatctgatcggaagaaatatgaatcaatggctcgtaattggacccaaaagtttgctatgaattgagttgttgtattcatataaagctcatgtgctataatttgtaacaaaagatcaatgattttctcctccgcaggcatgtaataaaagcacaaaattataatacttgtgaaatgagaatttttcacacttgata

SEQ ID NO: 1984 - DNA, 500 bp, Artificial
  Synthetic
ttttaaatcgtaatacatatatacacaaaagtgaataattgagatggtttggtacaaagttgtttttttaaggatgttgggttacatcaaagcatggaatcacttaaatagttttggaaacacaagacatgaatgaaaagagaagaaagctgttgctgaatcgtgattgagagaaagtagagagagctacaacgcttacaacaaactactactagtcagcagtccagctttgctcaacaacatcacgcactctcctgttgtactcgcgcttgctttcgctgtacatccgagcagcttccgagtttgcaggagaattcggattagggtcacagagcaaggactggatggaggtaagtatagcagcaacatcatagattggactccactggttttgtagaatgtccaagcagatactcccatctgcataaatattaggatgaaacatccgtgacacaaaccgaactgttggtggtttattgggataatcttcagagaactgc

SEQ ID NO: 1985 - DNA, 566 bp, Artificial
  Synthetic
gcagtgctggcccagttgctgaagacatgtttcattggcaagctacaataatgggtccatctgatagtccttattcaggcggtgtctttctcgtaaccattcacttccctccggattatcctttcaaaccaccaaaggttgcattcaggacaaaagtgttccaccctaatgtcaacagcaatggaagcatttgccttgacattttgaaagaacaatggagtcctgcactcaccatatcgaaggttttgctttcgatatgttcattgttaacggacccaaacccagatgatccattggttccagagattgctcacatgtacaaaaccgatagagcaaagtatgagtctactgcgagaagctggactcagaaatatgcaatgggatgaaagtttgtgtcctttgatccctcacagactcggttttaatagagagagagagagaaagagagaggacttcttcacatagggatcttccatgaaataagttagattcctatgttttatcatctctttgtttgaaacctctttaatctcaaacaaaaacattacttcacctctttattatcc

SEQ ID NO: 1986 - DNA, 541 bp, Artificial
  Synthetic
aaggatcctcctacttcatgtagcgcaggacccgttgcggaagacatgtttcattggcaggccactataatgggtccatcggatagcccttattctggaggagtttttcttgtaaccatccatttccctccagattacccatttaagcctcctaaggtggcttttaggacgaaggtgttccatccaaacattaacagcaatggaagcatctgcctcgacatcttgaaggagcagtggagtcctgctctcacaatttccaaggtgctgctatcgatctgttctttgttaacggatccaaacccagatgatcctttggtccctgagatagctcacatgtacaagacagacaagaacaagtacgagtccactgctcggacctggacccaaaagtatgccatgggctgacacaaatactgtccttaaggaagagccctaataattaaactcttcttatttctatgtaatgatcttttatagacttgtctgtcttataaaatttgtgaagacaggatcagtaagaaattatttgatctccattcaa

SEQ ID NO: 1987 - DNA, 748 bp, Artificial
  Synthetic
cccacgcgtccgaaggctctctctgtctctttctcaaaatcatctgcaggaagtgaatcgtcaaaaccgagtttggaggatctgtcttgagggtttggttttttggatctaggagtttttttttggttgagaaatggcttcgaaacggatcttgaaagagctcaaggatctccagaaggatcctccaacttcctgcagtgctggcccagttgctgaagacatgtttcattggcaagctacaataatgggtccatccgatagtccttattcaggcggagtgtttctcgtaaccatccacttcccaccggattatcctttcaaaccaccaaaggttgcattcaggacaaaagtgttccaccctaatgtcaacagcaacggaagcatttgccttgacattttgaaagaacaatggagtcctgcactgaccatatcgaaggttttgctttcgatatgttcattgttaacggacccaaacccagatgatccattggttccagagattgctcacatgtacaaaaccgatagagcaaagtatgagtctactgcgagaagctggactcagaaatatgcaatgggatgaaagtttgtgtcctttgatccctcaaagactcggttttaatagagagaagagagaaagagagaggacttcttcacatagggatcttccatgaaataagttagattcctatgttttatcatctctttgtttgaaacctctttaatctcaaacaaaaacattccttctcct

SEQ ID NO: 1988 - DNA, 250 bp, Artificial
  Synthetic
aatctccagtgccttttaagccggcgacgaacataaggccgccgcctatcatttaacctcccgtcgacgtctatcattcaattctcgccgctttttgctcgtaggtcaacaattccgtatttcttatgcggtgaggatgtcgacaccggcgaggaagagactgatgagggattttaagcgattacagcaggatcccccggccggcatcagcggagctccgtgtgacaacaatataatgctatggaatgca

SEQ ID NO: 1989 - DNA, 631 bp, Artificial
  Synthetic
tctgactcctctctctctctctctttagatctctggtctccgtctccgtgtccgtctccgttactgtgtctgtctcccttccgtcgagatctgtggatcttatagcctagccctaaaggggaacagcaagctttggactttccatggcctccaaacggatcctgaaggagctcaaggatctgcagagggatcctcccacatcatgcagcgcaggacctgttggggaagatatgtttcactggcaggcaacaatcatgggaccgaatgatagtccatatgctggcggtgtgtttatggtgaccattcatttcccaccggattaccccttcaagccgccaaaggttgctttcaggactaaagtttttcaccctaacatcaacagcaatgggagcatttgcttggatatattaaaagagcaatggagtcctgctcttacaatatcgaaggtcctgctgtcaatttgttcgctcctgacggatccaaaccccgatgatccccttgttcctgagattgcgcatatgtacaagacagacagagccaaatatgaaggcactgcaaggagttggacgcagaagtatgcaatgggctgaatctctgacctctctcgcccctttgtaataatcaaaagata

SEQ ID NO: 1990 - DNA, 670 bp, Artificial
  Synthetic
tccttgacagtgtgtgttcttctttctcgcacttgttccgtgtgcccggggttagccctagggcgatctttgcgcgatccgggcaggggatcggggccgcggcgcatccacgcgggcgatgcgctagattgggcacccggcggcgaggatcagggtttggatttgtcggtagcaatagccctatcgatctccatcgatcgatcgagctgggcggcgggggaatgggcgagagccaggcgagcctcctcttgcgcaagcagttgaaagatttgacaagaaatcctctggatggattctcggctggattggtggacgattccaatgtgtttgagtgggcggtgaccatcatcgggccaccagacaccttgtatgaaggtggttatttcaacgctatcatgagctttcctctgaattatccgaatagtcctccgaccgtgagatttacgtcggatatgtggcatccaaatgtttacccggatggtcgtgtttgcatctccatccttcacgctcctggagacgatccaaatggctacgagctggcgagcgaacgatggtctccagttcacacggtagaaactattcttttgagtataatctcgatgctttcgagcccaaacgacgagtccccagccaacatcgacgccgctaaagagtggcgagagcgaagaga

SEQ ID NO: 1991 - DNA, 876 bp, Artificial
  Synthetic
ggacagtatgtctactccatccaggaagcgcttgatgcgagatttcaagcgcctccagcatgatccacccgccgggatcagcggcgcgccgcaggacaacaacatcatgctgtggaatgcggtgattttcgggtaagagaggccgcttctagggtttagagtttctaaaggacttttttcgtggtttgctgcaggcctgacgatactccctgggatggagggacattcaagctgacattgcagtttacggaggactaccccaacaaacctcccactgtgagatttgtttcaaagatgttccatcccaatatttatgctgacggaagtatttgcctcgacatcctgcaaaatcaatggagtccaatctacgatgtcgcggccattcttacttccatacagtcattgctttgtgatcctaacccgaactcgccggccaactccgaggcagctcggatgtacagcgaaaaccgccgagagtacaacaggagagttcgcgacatagtcgagcagagttggacggcggagtagctccccttggttcaagagcttgtaagagtggccatcacagagagatgtgtgctgctccgagcacacataaagaatcttgtcaaaaaacaatccggaaagctgtcgcctctacagaccagcgttgaaggtcgaccatcgaactcgtttgcttctgttggaaccagggccagtgttctggtactcaccatagaacagggtgctgagagcgaagtccccgttccattccaaccatccacggggttgaattatgtcactgatgaacgacttcatgaacaccgtccgcgagtagagcttccacggccttccgagtttatgaaagacagccccgtgttctgtcgcttatcgacg

SEQ ID NO: 1992 - DNA, 643 bp, Artificial
  Synthetic
gggggaagggcgattagggtatattggctttgtcgcggctatggcgtccaagagaatcctcaaggaattaaaggacttgcagaaggatccgcccacttcgtgtagcgcaggtcctgtggccgaggatatgtttcattggcaagcgacgataatgggtcctcccgatagcccctacgcagggggtgtgtttttggtcaccatccatttccccccggattatccctttaagccccccaaggtcgcatttagaacgaaagttttccacccaaacatcaacagcaatggcagcatctgcctcgacattctcaaggagcagtggagcccggccttgacaatctccaaggtgctgctatcaatctgctcgttgctaaccgatccaaaccccgacgatccactggtgcccgagattgctcacatgtacaagacagacaggcccaagtatgaatcgaccgccaggaactggacgcagaagtacgccatggggtaagcccgggcttgtgagcggcggcggcggcggtggcggtggcatggctcgctatgatgtttgtgataccatttggttgcctatctataagttgaaagcagggattgtctttgattatggaattcttttgattactgtatatagaatttctatcacgtc

SEQ ID NO: 1993 - DNA, 705 bp, Artificial
  Synthetic
cgcgattgtagatgctatagatccaggtcgcctcgtcgtcgtcccgtggcgccgctgtagatagggtttgattcatcgcgcagcagcggcagcggcgatgtctacgccggcgaggaagcggctgatgcgggatttcaagcggctgcagcacgatccaccggcgggcatcagcggcgctccacaggacaacaacatcatgctgtggaatgcggtcatctttgggccggatgatacgccatgggatggaggaacattcaagctcaccttgcagttcacagaggattatccaaacaagccaccaaatgtgcggtttgtttcgaagatgttccatcccaatatttatgcggacggaagcatttgcctggacattctccaaaaccagtggagcccgatctacgatgttgctgcaatattgacatcgatccagtctctactatgcgatccaaacccgaactctcctgctaattccgaagccgcacggatgtacaacgagaacaggcgagagtacaacaagaaagttcgccaagtcgtggagcagagctggacagcgaacgactgaaaccgagagttctgctcggctgctcgacatgctggtacgcgattttctggcgatcacggacggaattctactaaccagcaggagcactgtatatcctctgtactcggattttttttcttaggtgatgtggttgcaactaagaaagt

SEQ ID NO: 1994 - DNA, 610 bp, Artificial
  Synthetic
gcgagagagagcaggaaggcgatcgatcagctcccggcggcgctgtcggaatccggatcttggagccgctgccatggccagtaccatcgccaacagcaatctcccgcggcggatcatcaaggaaacgcagcgattactgaccgagccagccgaaggcatcaaagcttcgcctgccgaagataatttgcgatacttcaatgtgatgatccttggccccgcacagtcaccctatgaaggtggtgcttttaaactggagctttttcttccggaagaatatccaatggctgctccaaaggttcgcttcttgacgaaaatttaccatccaaacatcgacaagctgggccggatttgcttagacattctaaaagacaaatggagtcctgctctccagattcgaacagtgcttttgagtattcaagctcttttgagtgctcccaatcctgaggatcccctggacgagaacatcgcgaagcactggaagacagaccaaggaggagccatcgcgactgcaagagagtggactcaactctacgcgacccataattaaatcaaaatgcggaccattcgtcatcttggttcgtttagttttttctgctttggtcatatttgt

SEQ ID NO: 1995 - DNA, 653 bp, Artificial
  Synthetic
gggaacgcgggaaggggcggcaacggcgatggcgctggcgtcggcggcggccttgtgacagtcaaccacagcatgctcgttgcggctgccgccactgccactacagcgtcgatcgaattcttgtattcctgcaagctagggtggggcgagaatgctgtcgtcggcccagttgcggctcatgtccgacctcaaggcgattcaacaggagccgccagagggatgtagtgctagtccacaaggcgaagagaatctctttgtgtggggagccactgtgtttgggccggatgaaacaccatgggaaggggcgatcttgcctcttcgtctcacctttggcgagcactacccggcgaagccaccgcgcgtgagattcacgtccgaagtgttccatccaaatgtctacagtgacggcgcactgtgcatggatatcatccaggatgcatggtctccttgccacaacgtcagcaccattctcacctcgattcagtctctcctgactgatccaaatccagcgagtccagcgaatcccgaagccgcgcatatgtatcaaaacgatctccaagcatacaacaggagagtgcgccagtgtgtgaggaagtccctagatatataaaactccaaagttttatttatctatctatcatagtgattatcta

SEQ ID NO: 1996 - DNA, 557 bp, Artificial
  Synthetic
tactccatccaggaagcgcttgatgcgagatttcaagcgcctccagcatgatccacccgccgggatcagcggcgcgccgcaggacaacaacatcatgctgtggaatgcggtgattttcgggcctgacgatactccctgggatggagggacgttcaagctgacattgcagtttacggaggactaccccaacaaacctcccactgtgagatttgtttcaaagatgttccaccccaatatttatgctgacggaagtatttgccttgacatcctgcaaaatcaatggagtccaatctacgatgtcgcggccattcttacttccatacagtcattgctttgtgatcctaacccgaactcgccggccaactccgaggcagctcggatgtacagcgaaaaccgccgagagtacaacaggagagttcgcgacatagtggagcagagttggacggcggagtagctccccttggatttgtgggtaagacagcatttatgggtgatcttttgcaatatatatgttgcattggttagatcacagcactggcttcttgagtatgtatatg

SEQ ID NO: 1997 - DNA, 570 bp, Artificial
  Synthetic
acgacaccaattttaaaaaatggctttgaagcgaatcaacaaggaactcagtgatcttggacgtgatcccccctcctcttgctctgctggtcctgttggccaggatctgttccactggcaggctactatcatgggaccctcagactctccttactccggaggtgttttctttctgtctatccacttccccactgactaccccttcaagccaccaaaggtgaccttcactacccgaatctaccaccccaacgtcaacaccaacggatccatctgtctggatattctcaaggagaactggtctcccgcactcaccatctccaaggtgctgctgtccatctgctccatgctcacagaccccaaccctgacgatcctctcgtgcccgacattggccacctgtacaagaacgaccgagcacgatacgacgccactgccaaggagtggaccaagaagtatgccgtctaggatgtatatagggagcaggcatgagcctatgcaagcgaatggctgtgacgatacaactagccaatgttagatttatggatggtaaaacaatgtgtgtcgaggaaaaa

SEQ ID NO: 1998 - DNA, 627 bp, Artificial
  Synthetic
acaggaccgccatcagggactctgcacccccgatcagataaagcctctacctagcgctcaggacttgcagacggtcgccttgcatcgtctccaacgtccgcctaggatcttttgattctttctttgcctcctcgatccgagatcgatcttccaccacccttttagataccacataccctcatcacaatggccctgaagcgcatcaacaaggagctcaaggacctcggcactgacccgccatcatcctgctccgctggtcctgttggagaagatctgtttcactggcaagctacaatcatgggacccggtgattcaccatactcaggaggcgtcttcttcctgaagatccagttccctacggattaccccttcaagcccccgaaagtcaacttctccaccagaatctaccaccccaacatcaacagcaacggcagcatctgcctcgatattcttcgagaccagtggagccctgctctgaccatttccaaagttctcctttccatctgctctatgctgacagacccgaaccccgatgatccccttgtgcctgagattgcgcacgtgtacaagaccgaccggccccggtacgaggcgactgctagggaatggacccgcaagtacgccgtc

SEQ ID NO: 1999 - DNA, 647 bp, Artificial
  Synthetic
ccccttttggctaccctacaaccttcttgagacccctttaaattcctcactttctctctctagaatctctctctttttctctctctatctctctctgaagtcgtatggcttcaggttctccttcacaagccagtcttctccttcagaaacaactcaaagatctcaatagaaacccagttgatggattttcagcaggtttagttgatgaaaataacttatttgaatggagtgttacaattattggcccccaagatactctatatgaagggggtttctttaatgctatcatgagttttcctcaaaattatcccaacagtcctccaactgtgagatttaccacagatatctggcatcctaatgtttactccgacggaaaagtttgcatctcaattcttcacccgcccggtgatgatccaaatggctatgagcttgccagtgaacgttggtctcctgtccacacggtagagagtatagttttaagcatcatatccatgctttcgagccctaacgatgagtctcctgctaacgttgaagctgctaaggaatggagggaaaaaagagatgaattcaagaaaagggtcagtcgttgtgtaagacggtcacaagaaatgtagtaaacatgcatgccaacctgcatttctgcgatt

SEQ ID NO: 2000 - DNA, 780 bp, Artificial
  Synthetic
cccacgcgtccgagaggactctatcatcatcatccatggcttcgcaagctagccttctccttcataaacaactcaaagatctctgtaagcatcctgttgatggattctctgctggtctcgttgatgagaagaatatattcgaatggagcgttaccattatcggacctcctgatactctctatgaaggaggattctttaacgcgattatgacatttccgcaaaactatccgaatagtccgccaaccgtgaggtttacttcggatatgtggcatcctaacgtttattctgatggtcgtgtttgcatatctattcttcatcctcccggtgatgatcctagcggttatgagcttgcaagcgagcgttggactcctgttcatacagttgagagtattatgttgagtatcatatcaatgctttctggtcctaacgatgagtctccagcaaatgttgaagctgccaaagaatggcgagataagagagatgagttcaagaagaaagtgagccgttgtgtcagaaagtctcaagaaatgttttgatcaacgtcaaacttcacacctttgagatctctggagtttcaatcaaaagttcttcatattcctatctgaaaccctttgaaacgcaacttgttataactcggtttacatctctttttgtcgcgttcgagaaccagagcgttttgaaaggtgtttggttgagaaaagtgctgttcttgagaaactggtattaaaattataaatttcatttgttaagaatcttctttgcttataaagttatccccct

SEQ ID NO: 2001 - DNA, 685 bp, Artificial
  Synthetic
ctctctccccctttccaccctccccgctaccccacccaacccccatcaactgaagtctatggcttcagcttctcaagctagtctcctccttcagaaacaactcaaagatctctgtaaaagaccagttgatggattttcagctggtttggttgatgaaaacaacttattcgaatggagtgtcaccattatcggacccccagatactttatatgaagggggtttctttaatgctatcatgagctttcctcaaaattatcccaacagtcctccaactattaggtttacctcggaggtgtggcatcctaatgtttattctgatggaaaggtttgcatctcaatacttcacccacctggtgatgatccaaatggatatgagcttgctagtgagcgttggtctcctgtccatacggttgagagcataatattgagcatcatatcaatgctttcaagtcctaatgatgagtctcctgctaatgtggaagccgctaaggaatggagagataatagagatgaattcaagaaaaaggtcagtcgttgtgtaagacggtctcaagaaatgacataaagacacgaatgccaaaatcggacttctttcatcagttgttgtttgatacaaatgtagaattgttgtcaaggtctgtcataccttttgtaatatttgcgagtacggtcattatttacattt

SEQ ID NO: 2002 - DNA, 636 bp, Artificial
  Synthetic
cggacgcgtgggcgcaaacggcgaagcagaagggggaagagagagagagagagagagagagagagaggggactcagcgagcggtgggcgagagggggagatcgaaaccctagctagggtttgcgcgcggcggcggcggggatgtcgacgccggcgaggaagcggctgatgcgggacttcaagcggctgcagcaggacccgcccgcggggatcagcggcgcgccgcacgacaacaacatcatgctctggaacgccgtcatcttcgggccggatgatacgccgtgggacggaggcacgttcaagcttaccttgcagtttacagaagattatcccaacaagccgccgactgttcggtttgtttctaggatgttccacccaaatatttatgcagatggaagcatctgcttggatattctacagaaccagtggagccctatatatgatgttgctgccatattgacttcaattcagtctttgctgtgtgatccaaaccccaactctccagcaaactcagaagctgccagactgtttagtgagaacaagcgagagtacaaccgcaaggttcgtgagatcgtggagcagagctggacagctgactagggcatgcagcagggcaacgggtggtatccaccatgcc

SEQ ID NO: 2003 - DNA, 584 bp, Artificial
  Synthetic
ggaatggcatcctctgctcagcttcgattgatgtccgatctgaaggccattagccatgagccacctgagggatgcagtgccagcccttatagcgatgcggacctttttgtttgggacgccacaatatttggtcccgaagatactccatgggaatgttgttcctgtgaccggatccatctttcgaaacttgaaaattagatcaatgaacctatctgtaactttgtgttctattgtatgcttgtgtttcttgtaggtggcattttctgcctccgtttggtctttggagagcattaccctgccaaaccacctcgtgtcaggtttacttccgagatatttcaccccaatgtgtacaatgatggcaccttatgcatggacattatacaagatgcttggtctccttgccacaacatctgtacaattctaacatctgttcagtcattgctaacagatccgaatcccgcaagcccagctaactcggaagctgcacatttatatcaaactgatattcaagcatataacaggcgagttcggcgttgtgtgaggaagtctttggaaagcacatagtatactttgctttgcttgtt

SEQ ID NO: 2004 - DNA, 813 bp, Artificial
  Synthetic
cccccccgacctgcgaactctccacgcctccacaaataaagctcgtcccgaggaagggcggcgacccaccccccccaatcgccaaaaccctaactccgatccgatcgagctctgcttcccatggcgactgccgcgagccaggcgagcctcctgctccagaagcagctcaaagatctcgcgaagaaccccgtggatgggttctcggcggggcttgtggacgatagcaacgtgttcgagtggcaggtcaccatcatcggcccgcccgataccctgtatgatggaggctacttcaatgcaataatgaccttcccccagaattatccgaatagtcccccatcagtaaggtttacctctgagatgtggcatccaaatgtttatcctgatgggcgcgtatgcatttctatccttcatccacctggcgaagatcccaacggttatgagcttgcgagcgaacggtggacacctgtgcatacagttgaaagtatagttctgagcatcatttcgatgctctctagtccaaatgatgagtctccagcaaatattgaagcggctaaggattggagagaaaagagggacgatttcaagaaaaaggttagacgcattgttcgtaaatcacaggaaatgctctgaaagataaggagcacaagggggagtaagcgagtgctacaacaggtgcactacacttaactgtctgtcgtcaaacgactacctaaagatagcatttttgcttcttcccctgtatatttccccctcagtgtcattcgagtggtgatgttggtcttgtctccgagatgctcggaaatgttgcctatt

SEQ ID NO: 2005 - DNA, 666 bp, Artificial
  Synthetic
cccaactccattattgattcttgcaagggggaagagcagctagaggcgaggcaagaaaagaagtgaaatctctccgttagacaggaagaggaaaagcaagggggaattggggatggcgtcaaagaggatacagaaggagctcaaggatctgcagaaggatccccctacatcatgcagtgcaggtcctgttggtgaagacatgttccactggcaggcaacgataatgggtccatctgatagcccatatgctggtggagttttcctagttaccatccacttccctcctgattatcccttcaaaccacccaaggtggcgtttcgcaccaaggttttccatccaaacatcaacagcaacgggagcatttgccttgacatccttaaggaccaatggagcccagcactaaccatttccaaggtgttgctgtcaatctgttccctgctgactgatccgaaccctgatgatcctctggtccctgagatcgcccacatgtacaagacagataggcacaagtacgagaacacagcaaggacctggactcagaggtacgccatgtagcacctcagatatcgatggacatgtcgatgttgtaacaacattatcaacgggtgtgtctccctctcgccttgtgtggtgtaaggatcaaaaccggctttgcagtgcactct

SEQ ID NO: 2006 - DNA, 809 bp, Artificial
  Synthetic
aggggggagagttcctgacctttcgtagccacgtttcttttcttctctctctctctctctctctctctctgtctttcgctttctctctctcctctcctttcctcttttccttctcattgttctcaaactacacccgctctctctccccttctctccttctctctctctctctctcttttgggtgccttccttgcgtatcgggaggagaacggaagaatggcttcgaagcggatcctgaaggaactgaaggatttgcaaagggatcctcccacttcctgcagtgcaggtcctgttggggaagatatgtttcattggcaggcaactatcatggggccaactgatagtccttatgccggtggcgtcttcatggtcactattcatttccccccggactaccccttcaagcctcccaaggttgctttccggacgaaagtgttccacccaaatatcaacagcaatgggagcatctgccttgatatattaaaagagcaatggagtccagcccttacaatatcgaaggtcttgctttcgatttgttcacttctcactgatccgaatcccgatgacccccttgtgccggagattgcacacatgtataagacggatcgagccaaatacgaaggtactgcaaggagttggacacagaagtatgcaatgggttgagttgagtctttcttcactcaattgctactcgctcttaatatatcccccccccttgatgtaataaatatatgttggcagacaagttaaaatatcggcatacaaaaagccgtgtttctgaatgatcttgtttcaaaactgaatgaatg

SEQ ID NO: 2007 - DNA, 643 bp, Artificial
  Synthetic
tttttgccgccatcgccgtctttccttccttcgatcgatccatccctcctcctcttcgcgatcaagcttctcctcctcccccccccccccaatggcctccaaacggatcctcaaagagctcaaggacctacagaaggacccccccacctcgtgtagcgccggccctgttgcggaagacatgttccattggcaggcaacgatcatgggacccgttgatagcccttacgccggaggtgtgttcatgttgacaatccactttcccccagactaccctttcaaacctcccaaggttgctttcaagacaaaagtatttcatccaaacatcaatagcaatgggagtatttgcttggatattttgaaagagcaatggagcccagctttgacaatctccaaggttttgctttcgatttgttctcttctcactgacccaaaccccgatgatcctctggttcctgagatagcacacatgtacaagatagacagagccaagtacgaatctactgcaaggaattgggcacagaagtatgctatgggctaatagttattataatggacgtcccattgcaatggtagacaggccgagggattgattacactttcctgttcttgttttcaaaccatggggggttggatgtatcttgtg

SEQ ID NO: 2008 - DNA, 712 bp, Artificial
  Synthetic
caaattcttaaaactatctccactatctctttctctctctagacaaattaagaacccttagcgtaaactctgcgaccgaagaaccccacccacccaggcagccttcaattcaattccaatggcgaacagcaatcttcctcgccgaattatcaaggaaactcaacggcttctcagcgaacctgcaccaggaataagtgcatctccatcggaagataatatgcgatactttaatgtcatgattcttggtcctacacagtctccttatgaaggaggcgtcttcaagctcgaactctttttgcctgaagagtacccgatggctgctcctaaggttcgattcctcaccaaaatctaccatccgaacattgataagcttggaaggatatgtcttgatattcttaaagacaagtggagtcctgcacttcagatccgtactgtacttttgagcattcaagcacttttgagtgctccaaatccggatgatccactctctgagaatatcgcaaagcactggaagtcaaatgaggctgaagctgttgaaacggctaaggagtggacacgcctatatgcaagtggtgcatgaaggcattagcaacgaaatatttaaaaataacaaaaattatggactgtatcctattgacttgcttatcaatatggatggctgttaatgcctggactcttccgattgcctcccataattgcttccctgtccttg

SEQ ID NO: 2009 - DNA, 758 bp, Artificial
  Synthetic
tgcgaactccaggggcacctcctccaacacaaagcaggagttcaacgcagaatcaaaccaaaaccctagctcaccgccttgtttcctccgtattggtggttacaatgtcgactccggctagaaagaggttgatgagagatttcaagaggttgcagcaggaccctcctgctggtattagtggtgcacctcaagacaacaacattatgctttggaatgccgtgatatttggtcctgatgacactccttgggatggtggtacgttcaagctgactcttcaattctctgaggattaccccaataagccaccaacagtgcggtttgtttctcgcatgtttcatcctaacatttatgcagatggaagtatatgtttggatattcttcaaaatcagtggagtccaatatatgatgttgcagctatacttacatccattcagtcattgctgtgcgatcccaaccccaattcacctgcaaattcggaagcagctcggatgttcagcgagaataaaagggattacaaccgcagagttagagaagttgtggagcagagctggactgcagactgattctaaggaagaaagatgtcattgctgaccgcaattcgggagcaccagggttcatctatgttacatttacggattgaaacctcttcttggaaattttattggaacacatttgttttggccctagtattatggcttggtgctgtttgccttaccgtttgctgcattgcattgacaagctcctgtaatatatgaatg

SEQ ID NO: 2010 - DNA, 846 bp, Artificial
  Synthetic
cagtttaagagagaaatataggacttcttccaacgtactggggtactattattggcccaaaatcctcttccagctctgcaatctccgtctccgtcaattttcagtcaaccgaaatccaccatctttcattgttcatcaccttcaggttagggtttggatttgaaggtacaaggggctaattgatggcgtcgaagaggatattgaaggagctcaaggatctgcagaaggatcctcctacatcatgcagtgctggtccagtggcagaggatatgttccattggcaagcaactatcatggggcctacagatagcccttatgccggaggtgtatttttggtttcaattcatttccctccggattatcctttcaagcctccaaaggttgcctttagaactaaggttttccaccctaacatcaatagcaatggaagtatttgtctggatattctaaaagagcagtggagtccagcgttaaccatatctaaggtcctgctctccatctgctccctattgactgacccaaatccagatgatccacttgtaccagaaattgcccacatgtataagactgaaaggtctaaatacgagaccactgctcgtagctggactcagaaatatgctatgggataatggcaaaggtgtcaccaggcatgtctgagactttgtaactgcaatgtcttattgtgcttgtagtgaatgaataaattcggctaaagaacttagtttacttcttaatctcccttaaagtgggttgtcaacagacatttcttttcaatttgtgaatatctatttggtgactattagtaagggagacacttcagtgtaattttacttcgtttgccagttt

SEQ ID NO: 2011 - DNA, 694 bp, Artificial
  Synthetic
agagagagagagagagagagagaggggtaggtaggaaagggtagcagcagcagcaatgggtagagttatcagggctcagaggaagggagcaggttccgttttcaagtcccacacgcaccggaggaagggccctgccaggtttcggtccctcgactatgcggagcgcaacgggtacatcaagggcgtcgtgtcggagatcgttcacgactctggccgcggggcgcccctctgcaaggtcaccttccgtcacccgttccggttcaagcaccagaaggagctcttcgttgccgccgagggcatctactccgggcagttcctctactgcgggaagaaggccaccctctccatcggaaacgtgctgccgctcaagtcggtccccgagggggccgtcgtctgcaacgtggagcagcgcgttggggaccggggtgctatcgccagggcctccggcgactacgccatcgttgtcagccacaaccccgacaacaatacctcaaggatcaagcttccctccggtgcaaagaagattgtccctagcgactgccgggcgatgattggtcaggttgcaggaggaggtaggactgagaagccgatgctgaaggccggcaatgcctatcataagtacaaggtgaagaggaactcctggcccaaggtgcgaggtgtggccatgaatcctgttgagcatccccatggagga

SEQ ID NO: 2012 - DNA, 980 bp, Artificial
  Synthetic
ttcacagagtgagcagagagccaaacagagaacgccgaaatgggtcgtgttatcagagcacaacgtaagggagcaggctccgttttcaaatcccacactcaccaccgtaagggccctgccaaattccgttcactcgattacggtgaacggaacggttaccttaaaggtgtggtctcagaaatcatacatgacccaggtaggggtgcaccgttggcacgcgtaacattccgaaacccgttccgttacaagcaccagaaagagttgttcgttgctgctgaggggatgtacactggtcagtttatttactgtggtaaaaaagctaatctaatggtgggtaatgtgttggcacttagatctatccctgaaggtgctgtcgtttgtaacgtggaacacaaagttggtgaccgtggtgtttttgctagatgctcaggtgattatgctattgtcatcagtcacaaccctgataatggaactactaggattaagcttccatctggagcaaagaagattgtgcccagtgggtgtagagccatgattggccaggttgctggtggaggaagaactgagaaaccaatgctcaaagctggaaatgcataccacaaataccgggttaagaggaactgctggcctaaggttcgtggtgttgctatgaatcctgtggagcatcctcatggtggtggtaaccatcaacatattggtcatgccagtactgtccgccgtgatgcaccacctggacagaaggttggtcttattgctgcaaggagaactggtcgtcttcgtggtcaagctgctgctactgctgccaaggctgacaaggcttaagatattaagtttgttacttttttcattgtcgttgtattctgatcggatttgagaccgtctttatactaagttctgtttggatattatttagtaaggtttgtttaggaaccctcgtttggacaagtttgccacttataaatgtgttttagcttggctct

SEQ ID NO: 2013 - DNA, 564 bp, Artificial
  Synthetic
aaccaggtaaaaacttctttaggtggaatgtaaaatccagaccatgaccacgaaaactgcgaacattcatcacaaatgtgaccagagtaccaagcaaaaagcacgaccatactggaatacatgtcctttaatctagcgatgataagcatggtagcgaatatggatagtaacaacaataagtaacactctaagtggccttgtcggccttggcagcggtagcggcggcctggcctctgagacgaccagtcctccttgcagcgatgagaccaaccttctggccaggaggtgcatcacggcggacggtggacgcgtgaccaatgtgctggtggttacctcctccgtggggatgctcaacggggttcatggccacaccacgcaccttaggccagcagttcctcttcacgcggtacttgtggtaggcgtttccagccttgagcatcggcttctcagtcctgccaccaccagcaacctgaccgatcatggcacggcagctgctggggacaatcttcttggcaccagaggggagcttgatcctggatgtgccgttatcggggttgtggctga

SEQ ID NO: 2014 - DNA, 696 bp, Artificial
  Synthetic
agcggccggactcagctacccgtaacatcgcagccagcgacgtcgagtcaccatgggtagagttattcgcaaccagagaaaaggccgtggctccatcttcacggccaacacccgcctgaacaaggctcccgccaagttccgcaccctcgattacgccgagcgccatggctacgtccgtggaatcgtgaaggacatcatccacgaccctggtcgtggtgctcctctcgccaaggtccagttccgccacccttataagtataagcaggtcaccgagaccttcatcgccaacgagggcatgtacaccggccagttcatctatgccggaaagcgcgctgctctgaccgtcggcaacgtcctgcccgtcggtgagatgcccgagggtaccgttgtctccaacgtcgaggagaagattggcgaccgtggcactctcggccgtaactctggtggctacatcaccattgttggccacaaccccgatgagggcaagacccgtatcaagcttccctctggtgccaagaaggtcgtccactcccgatctcgtggcatgatcggcatcgttgccggtggtggccgtaccgacaagcctctgttgaaggcttctcgtgccaagcacaagttcgctgtcaagcgtaacagctggcccaagactcgtggtgttgccatgaaccccgtggaccaccctcacggttgtggtaa

SEQ ID NO: 2015 - DNA, 563 bp, Artificial
  Synthetic
gataatcaacaatgggtcgtgtcattcgaaaccaaagaaagggtgctggttctatcttcaccgcccacacccggctccgaaagggcgctgccaagctccgagatctcgactacgccgagcgacacggatacatccgaggtgttgtcaaggagatcatccatgaccccggtcgtggtgctcccctcgccaaggtcgtcttccgagacccctacaagtacaagcagcgagttgagaccttcattgctaacgagggtgtctacactggccagttcatctacgccggtaagaaggctactctgaacgtcggaaacgttctgcccctgggctctgtccccgagggtaccatcctctccaacgtcgaggagcacgccggtgaccgaggtgccattggccgaacttccggtaactacgtcattgtcatcggccacaaccccgatgagggcaagacccgaatcaagcttccttccggatctaagaagattgtcccctctaccgctcgaggtgtcatcggtgttgttgccggtggtggacgaatcgacaagcccctgctcaagggcggccga

SEQ ID NO: 2016 - DNA, 765 bp, Artificial
  Synthetic
aaagcgaggaagcagcaatgggtcgcgtgatccgggcacagcgtaagggtcgcggctccgtctttaagtcgcacacgcaccaccgcaaggggccggcgcggctgcggaagctcgacttctcggagcgcaatggctacatcaagggcgtggtgacggagctgatccacgacagcgggcgaggggcgccgctctgcaaggtgacgttccgccaccccttccggttcaagcaccagaaggagctcatgatcgcggccgagggcatctactcgggccagttcatgtactgcggcaagaaggcccagctcgccattgggaatgtcctgccgctgcggtcggtccccgagggagcagtcgtttgcaatgtcgagcaccgtgtcggggacaggggttcattcgcccgggcctctggggactacgcgattgttgttagccacaacccggatatgggaacctcacgtatcaagcttccgtcgggcgccaagaaaatcgtccccagcggctgccgcgcgatgatcggtcaggtggcgggcggtggcaggaccgagaagccgctgctcaaggccgggaacgcgtaccacaagttccgcgtcaagcgcaacagctggcccaaggtgcgtggtgtggctatgaatcccgtggagcatccccacggaggaggtaaccaccagcacattggtcacgccagcactgtccgccgcgacgcccctccgggccaaaaggtgggtctcattgccgccaggaggaccggacgtctccgcgggcaag

SEQ ID NO: 2017 - DNA, 288 bp, Artificial
  Synthetic
gtctcgccgcgacgaggagatgggtcgcgtgatccgcgcgcagcgtaagggtgcgggctccgtgttcaagtaccactacccaccagcagaagggccccgcgaggttccgctccctcgacttcggcgagcgcaacggctacctcaagggcgtcgtcaccgacatcatccacgaccccggccgcggcgcgccgctcgccaaggtgacgttccgccacccgttccggtacaagcaccagaaggagctgttcgtcgcggcggaggggatgtacacggggcagttcgtctact

SEQ ID NO: 2018 - DNA, 983 bp, Artificial
  Synthetic
cccacgcgtccgctcaaaaccctaatatctgaacttcgccgtcgagagcatccatgggtcgtgtcatcagagctcaacgtaagggtgcgggttccgtcttcaaatcccacactcaccaccgcaaaggtccggctaagttccgtagcctcgatttcggcgagagaaatggttacctcaagggcgtcgtgacggagatcatccacgatcctggtcgtggtgctcctcttgctcgtgtcactttccgtcatcctttccgtttcaagaaacaaaaggagctcttcgtcgccgccgaaggtatgtacaccggtcagttcttgtactgcggtaagaaagctactctcgtcgttggaaatgttctccctcttagatctattcctgaaggagctgttgtctgcaacgtcgagcatcacgtcggtgatcgtggtgtcctcgctagagcttctggtgattacgccattgttatcgctcacaaccctgacagcgacactactaggattaagttgccatcgggttcgaagaagattgtcccaagtggatgcagggctatgattggacaagttgctggaggtggaagaactgagaagccgatgctcaaggcaggaaacgcgtaccacaagtaccgtgtgaagaggaactcatggcctaaggttcgtggtgtggctatgaatccagtggagcatcctcatggaggaggtaaccatcagcacattggtcacgccagtactgttaggcgtgatgcacctcctggacaaaaggttggtcttattgctgcaaggaggactggtcgtctcagaggtcaagctgctgcttcagctgccaaggcagactagagttaaaagagataaactttgtttctcttgttttctatgtttcaagttttgttgtctgtgtttccttttgaacctcattctgaaatcctaaaagatttttatgataaacctttctctcttctcgaaaagcttatgttattcacattgcatcct

SEQ ID NO: 2019 - DNA, 911 bp, Artificial
  Synthetic
cgttatttattatgcatcttgactacccctcgaccacgcgtccggccgagcaagctcgagagagggagagagagagacggcgaaatgggtcgtgtgatcagagcacaacgtaagggagcagggtcagtcttcaagtcccatacccaccaccgtaaaggccctgcccgtttccgttccctggacttcggcgaacggaatggttacctcaagggtgtcataacggaggttattcatgatccaggtaggggtgccccattggcgcgtatcactttccgtcacccgttccgttacaagcaccagaaggaactgttcgtggctgctgagggtatgtacactggccagttcgtttactgtgggaagaaggctactctcatggttgggaatgttctcccactcagatctatccctgaaggagctgtcgtttgcaatgtggaacacaaggttggtgaccgtggcgtttttgccaggtgctctggtgattatgctattgtcatcagtcacaaccccgataacggaaccactaggattaagctgccatcaggatccaagaagattgtgcccagtgggtgtcgtgccatgattggtcaagtagctggaggaggacgtactgagaaaccaatgcttaaggctggtaacgcgtaccacaagtaccgggtaaagaggaactgctggcccaaggttcgtggtgttgccatgaaccctgtggaacatcctcatggtggtggtaaccatcaacatattggtcatgctagtactgtccgtcgtgatgcaccacccggccaaaaggtcggtcttattgctgcaaggaggactggtcgtcttcgtggtcaagctgctgctacagctgccaaggctgacaaagcttaaaaagtttagcttgttactgtttttccctacttgtttcctgatta

SEQ ID NO: 2020 - DNA, 661 bp, Artificial
  Synthetic
cccccgctcctccggcgcgagagagagagagagagagacggcgaaatgggtcgtgtaatcagagctcaacgtaagggagcagggtccgttttcaaatcccacactcaccaccgtaaaggtccggcccgattccgtaccctcgatttcggcgaacgtaatggttacctaaagggagtaatcacagaagtgattcacgatcctggtagaggagcaccactcgcgcgcgtgacattccgtcacccgttccgttacaagcaccaaaaagagttgttcgttgctgccgaagggatgtacactggtcagttcgtttactgtggtaaaaaagctactcttatggtcggtaatgtgttgcctcttagatctataccagaaggagctgttgtatgtaacgtggagcataaagtaggagatcgtggtgtttttgctagaagctctggtgattatgccattgttatcagtcacaaccctgataatggtaccactagagttaagcttccatcaggagccaaaaagattgtacccagtggatgtcgtgccatgattggtcaagttgctggaggaggacgtactgagaaaccaatgctcaaagctggtaatgcttaccacaagtaccgggtaaagaggaactgctggcctaaggtccgtggtgttgctatgaatc

SEQ ID NO: 2021 - DNA, 442 bp, Artificial
  Synthetic
aacatctcgacgacgactgaggccacgtcaggatgggaagagttattacaaatcagagaaagggccgcggctcgatcttcaccgcccatactcgactgaacaaggcaccggcgaagttccgatccctcgactacgctgagcgacatggctacgttcgtggtgttgtgaagcagatcattcacgatcctggccgaggcgcaccactcgcaaaggtccagttccgcgacccataccgatacaagctgcgaacagagaccttcatcgccaacgagggcatgtactctggccagttcatctatgccggcaagaacgctgctttgactgttggcaacatcctgcctctgagcgctgttcctgaaggtaccgtcgtttccaacgtcgaggagaagatgggtgaccgtggcgcacttggacgcacttccggtaactacgtcaccgtcat

SEQ ID NO: 2022 - DNA, 169 bp, Artificial
  Synthetic
tgctcctcttgtcaagatcgtcttccgcagcccctacaagttcaaacaacagaccgataccttcatcgccaactagggcatgtacactggccatttcatctacgccggaaagaacgctgctcttaccgttggaaacgagctgcctctgggctccatgcccgagggtacc

SEQ ID NO: 2023 - DNA, 656 bp, Artificial
  Synthetic
gttctagatcgcgacggccgcccttttttttttttgttgaagactactgacaattaccatgagctaattcaacaactcaaggattaaataaccaggtaaaaacttctttaggtggaatgtagaatccagaccatgaccacgaaaactgcgaacattcatcacaaatgtgaccagagtaccaagcaaaaagcacgaccatactggaatacatgtcctttaatctagcgatgataagcatggtagcgaatatggatagtagcaacaataagtaacactctaagtggccttgtcggccttggcagcggtagcggcggcctggcctctgagacgaccagtcctccttgcagcgatgagaccaaccttctggccaggaggtgcatcacggcggacggtggaggcgtgaccaatgtgctggtggttacctcctccgtggggatgctcaacggggttcatggccacaccacgcaccttaggccagcagttcctcttcacacggtacttgtggtaggcgtttccagccttgagcatcggcttctcagtcctgccaccaccagcaacctgaccgatcatggcacggcagctgctggggacaatcttcttggcaccagaggggagcttgatcctggatgtgccgttgtcggggttgtggctgatga

SEQ ID NO: 2024 - DNA, 281 bp, Artificial
  Synthetic
cgccgacgaggagatgggtggcgtgatccgcgcgcagcgtaagggtgcgggctccgtgttcaagtcccacacccaccaccgcaagggccccgcgaggttccgctccctcgacttcggcgagcgcaacggctacctcaagggcgtcgtcaccgacatcatccacgaccccggccgcggcgcgccgctcgccaaggtgacgttccgccacccgttccggtacaagcaccagaaggagctgttcgtcgcggcggaggggatgtacacggggcagttcgtctact

SEQ ID NO: 2025 - DNA, 321 bp, Artificial
  Synthetic
ggaggagagaggagagaggagggaggaggaggaggaggaggaggaggagaaggcagacatggtggaaagactgagaaagcctttttgaagcagcccaaggtttttctctggtggcaagaaatcagggaaaggtaaaagaccaggaaagggcggaaataggttttttaagagcattggattggggttcaagactcccaaagaagcgatcaatggcacttacatagacaagaagtgcccgtttactgggaatgtctcaatcagaggtagaatcttaactgggactgtctactgctccaaaatgacgagaactatcattgttag

SEQ ID NO: 2026 - DNA, 691 bp, Artificial
  Synthetic
tagggttttgccgccgtgcatctatcctcgtccagttcagcttgtagtcctcaatcatggcggagcagacggagaaggcgtttttgaagcagccaggtgtttttctaagctcgaagaagacagggaaagggaaaaggccaggaaagggaggcaatcgctactttaagagtatcggtctagggttcaaaactcctcgtgaggctgttgaaggtacatacattgacaagaaatgcccattcactggcaatgtttctatccgaggtcgtatccttgctggtacatgccacagtgctaagatgaacagaaccatcattgttcgacgcaactacttacattatgtcaagaagtaccagagatatgagaagaggcactcaaacattccagcgcacatctcaccatgcttccgtgtgaaagagggagatcatgttatcattggacagtgcaggcctttgtccaaaaccgtgaggttcaatgtcttaaaggtgattccagctggttctgctggtggaggaaaaaaggcttttaccgggatgtgagctttgtgcttccatttcaactgttatttctaggaatgatgtcaagacttttctgcttttactgaattgttgccttcattgattttcctttgaacatcaaattttgtaacttaaatcttagcaattttttttaagcctatgtactactccactta

SEQ ID NO: 2027 - DNA, 524 bp, Artificial
  Synthetic
gaccagcaaaatgtccgagcttcacgtccagaacgagcgagctttccagaagcaacctcacatcttccagaacgccaagtccaaggtcaaccgaaagaccaagcgatggtataaggaggtcggtctcggattcaagaccccctctgccgccatcaccggtgactacattgacaagaagtgcccctttgttggtgacatttctatccgaggcaagatcctgactggtaaggttgtctccaccaaaatgcacagaaccatcatcatccgacgagagtacctccactacatccccaagtacaaccgatacgagaagcgacacaagaacctcgctgcccacgtctctcccgctttccgagtcgagaacggcgatatggttaccgttggtcagtgccgacctctctccaagaccgttcgattcaacgttctccgagttctgcctgccaccggtaaggctaacaaggccttctccaagttctaaacttgaaaaaatctagtaagatattgtattaaaaatcgtcaagctt

SEQ ID NO: 2028 - DNA, 511 bp, Artificial
  Synthetic
ggtgtagattttgttaaaatcagggttagggtttatcagcgggcggctagaggagcaaaagaagcgccatggcggagcagaccgagcgcgcgttcctcaagcagccgaaagtcttccttctcgccaagaacactggaaagggaaagaagccaggtaagggcgggaatcgattctggaagaacgttggattgggcttcaagaccccgcgggaggcaatcgaagggacttacatcgacaagaaatgtcccttcacgagcaatgtgtccatccgtggacgtattctctctggaactgtggccacgaccaagatgacccgcagtatcatcgtgaggcgggattacctgcactacgtgaagaagtaccagcggtatgagaagaggcactcgaatgtggctgctcatgtctcgccgtgctttcgcgtgaaagaaggtgacaaagtgatcatcggccagtgcagacctctctcgaagacgattcgcttcaacgtcttgaaggtgatgccgagaggagc

SEQ ID NO: 2029 - DNA, 871 bp, Artificial
  Synthetic
ctctagttacggtatctctccggagcaggataattcaagatggcgaccgagttgaccgtccagtcggagcgtgctttccagaagcagcctcacatcttcttgaactccaagaccaagaccaagagcgcccgaccgggtaagggaggacgacgatggtacaaggatgttggtctgggtttccgtacccccaagactgccattgagggcagctacatcgacaagaagtgccctttcaccggtctcgtctctatccgtggccgtatcctgaccggcaccgttgtttccaccaagatgcaccgaaccgtcatcatccgaagagagtaccttcactacatccccaagtactctcgttacgagaagcgacacaagaaccttgccgcccacgtctctcctgctttccgtgttgaggagggtgaccaggttaccgttggccagtgcaggcctctctccaagactgtccgcttcaacgtcctccgcgttctgccccgaactggcaaggcggtcaagtccttctccaagttctaaattgggtttctctactggcatttttggcgtgataaacatcgggggggaacgaatcatccccgctggagggtcggcatgggaagttgctttacaaaatgagttgtagacgcaatcgtgaataaaaaaggattcatgaccacgatctcgacgtctcagggttgtttacgacgcttaattcgattcccaatcacggagcccggtgcaaaaaagaaatcttgatgaggccctcaggtgatgaatgaataaaaacccaatgtttaaatatcaacaacaggtctcatggtacagcggaagcagtgattgtacaacagagaaaatatcgcgtgatatcaatgcacacggcata

SEQ ID NO: 2030 - DNA, 652 bp, Artificial
  Synthetic
cccccggccgccgcatcctccttcgcaagcctcgcctccactccccgcgccgccgccgccgccgccgactcgccggtcgtcaccctcgccccgcagccatggctgagcagactgagaaggctttcctgaagcagccaaaggttttcctcagctcaaagaagtctggcaagggtaagaagccaggcaagggtggcaaccgcttctggaagagcattggccttggcttcaagacccccagggaagcaattgaagggacatacattgacaagaagtgcccattcactggaactgtttctatcagaggcagaatcattgctggaacatgccacagtgccaagatgaacagaactatcattgttcgcaggaactacctccattttgtcaagaaatatcagaggtatgagaagaggcattccaacattccggctcacgtctccccatgcttccgtgtcaaggaaggtgaccatgtcatcattggccagtgcaggccgctgtcgaaaactgtgaggttcaacgtcctgaaggtcatcccagctggatccaccggcggcagcggcggcaagaaggccttcaccgcagcatgagcttgtactcgcattattcatgggtagtttatagacagatccttttgcttgaagtcctggcagggctg

SEQ ID NO: 2031 - DNA, 243 bp, Artificial
  Synthetic
cccacgcgtccgcctttgcctacaagctttcacgcgggagctcaacatcagccatggcggaacagactgagaaagcttttcttaagcagcctaaggtcttccttagctcgaagaaatctggaaagggaaagagacctggaaaaggtggaaaccgtttctggaagaacattggtttgggcttcaagactcctcgtgaagccattgatggagcttacgttgacaagaaatgccccttcactggaa

SEQ ID NO: 2032 - DNA, 762 bp, Artificial
  Synthetic
agccactcccctcgttccagttaagctttcagctccttcaactccacagccatggccgaacagacggagaaggcgttcttgaagcagccaggtgtttttcttagctcgaagaagacagggaaggggaagagaccagggaagggaggtaaccgctacttcaagagcattggtctagggttcaagactcctcgcgaggctattgaaggtacgtacattgacaagaaatgtccatttactggaaatgtttcaatcagaggtcgtatccttgctggtacatgccatagtgccaagatgaacagaaccatcattgttcgtcggaactacctgcattacgttaagaagtaccaaagatatgagaagaggcattccaatatcccagctcacatatcaccttgcttccgtgtgaaagagggagatcatgttatcattggacagtgcaggcctttgtccaagactgtgaggtttaatgtgttaaaggtgattccagctggttctgctggtggtggcaagaaagcatttacaggaatgtgagcaggtgtttcttgagtttactgtcacttctagagtatgaaagtaattatgcttgagactgagaagaggagtgacgttgagacttctctactaaaagctgtttgcgtttgcctttgaaggcttaaattttgtatggatacttgctacctatcattagtataaggagttcagatttcagtttttttgttaccattgttatttccaatcaaatgttcttcctgattgccccac

SEQ ID NO: 2033 - DNA, 683 bp, Artificial
  Synthetic
tttctaggttttaggtttaggaggaagaagaggagaggagcgccgtaggccagaggaggagcaaggcgatggcggaacagactgagaaagcctttttgaagcagccaaaggttttcctctgtagtaaaaaaacagggaaaggcaaaaggcctggaaagggtggaaacaggttttttaagagcatcggattgggcttcaagactccaaaagaagccgttaatggtacttatattgacaagaaatgcccattcactgggaatgtttcaatccggggtcgaatcctcacagggacggtccactgtgcaaaaatgactagaaccattattgttcgaagagactatctccactttgtcaagaagtatcaaaggtacgagaaaaggcattctaatcttgctgcccatgtttcaccttgtttccgagtcaaggaaggcgataaggttatcattggacagtgcaggcccttgtctaagactgtcaggtttaatgttctgaaggtaattccaatggggtcatctgatggaggaagcaaaaaatcatttgcaggaatgtaagcgtagtcactatctgcactagatgtagtggtcatacatttgcagggatttagcagatttttccattgggcttttgtgccgctggttcatgagtagtttgagttatggataatttaacacttaatttatccc

SEQ ID NO: 2034 - DNA, 643 bp, Artificial
  Synthetic
ggttaaagcttagagagacatctgcccttgcaagtgaagaggatcaatcgatcgatcagccatggcagcgagggtaagactattcaaggaatacaaggaagcaatgaaagacaaggctgttgactcagatattgtacttacttgtgatgatacaaacatatacaggtggacaggacacatcaagggtccagaagatacaccataccaagaaggtgtttttcagctagccataaatgttccagatcagtaccctctggtgccaccccaaatacggtttgtgaccaagatttttcacccaaacgttcactttaagacaggggagatatgcctagatattttgaaggcggcttggagcccagcatggacattgcaatctgtttgccgtgctataatagccctaatggctcatcctgaggcagatagtcctttaaattgcgattccggcaatctactaagatcgggtgataaccgtggattttattcgatggctcgtatgtacacccgattggcggcggcgccaaagccttgattctcttcacatcttttcaaaaaatatcaaggatttctcatagctactaagatgctttccatgtgaagaattatatattcgggcacaaatgatttggacacgtgggttttagag

SEQ ID NO: 2035 - DNA, 618 bp, Artificial
  Synthetic
ccccccgaacggctgcgcgtcttcccgttcgtcctcctgtccggtccgagcccctctgacgacgcgactttccccacgccgggatcgagctccggggaggggagctgcgagctgaaacactttgtcatatcagtcaacagtagagaggagaccagatgcaggcatctagagctaggctctttaaggagtataaggaggtgcagcgagaaaagtcagctgatccagatatccagttaatctgcgatgattcaaacatattcaagtggactgctcttatcaagggcccttcggagacaccttttgaaggtggtgtatttcaacttgcattctctattcctgagcaataccctctccttcctccgcaagttcgcttcttgaccaaaattttccacccgaatgtgcatttcaagacaggtgagatttgcctggatatcttgaagaatgcgtggagcccagcatggacactacaatccgtttgtagagccataattgcattgatggcccatcctgaaccagacagtccacttaactgtgactcaggcaacctcctgcgctcaggcgacatcagaggctatcaatccatggcaagaatgtatactaggttggctgccatgccaa

SEQ ID NO: 2036 - DNA, 783 bp, Artificial
  Synthetic
aaaataaaaccccctttttcccattccgatcaaattgaatcaattgatttaaggttcttctgagctgtgaagtgcttgttctgattataaaggattgaataaggatgcaggcttcaagggcaaggcttttcaaagagtacaaagaagtacagagagagaaatctgctgatccagatattcaattagtttgtgatgattctaatatctttaaatggacggctcttattaaagggccatctgaaactccttatgatggcggagttttccagcttgctttctcagttccggagcagtatcctttgcaacctcctcaagtgcggttcctgaccaaaatatttcacccaaatgttcattttaagactggagagatttgccttgatattttgaagaatgcatggagcccagcatggacactccagtctgtttgtcgagctataattgctttgatggctcaccccgaagctgatagtccactaaactgtgactcaggcaatcttcttcgatctggtgatatcagaggatatcagtcaatggcaaggatgtacactagacttgcagcaatgcccaagaaaggctaaaacaatgagctacaacctcgttcgcacagcttgtaataatggcattaacaaaagttgaattgttgcatatccgtgtttagtgttttctaacagcagtgcatgacctattgtttattaatccttttgttttttcgcatatttctgatacagctcatctcatttagcaggtttcttgtgtgcctttagcaagtggaatatgtataaa

SEQ ID NO: 2037 - DNA, 690 bp, Artificial
  Synthetic
atcataagtggggcaaaaaaagggttcatggcgaaggcgcacgaatccactgcggcactcctcttcttgatcgattaggtcagatcgaagtaggtcgatcgattgatagatagattggaaaaggattggcgaagatgctcgatgtgtcccgcgtccagaaggagctggtggagatcgagcgcgacaagaagctgtcgggcgtgagcattcaagtcttcgacgatgggttgagtcgaatgcgaggaacaatcacggggcctgttggcaccccctacgagggcggaatcttcaccatcgatattcagttaccttctgcttatcctttcgaaccaccaaagatgcaattcatgactaaagtctggcatccaaacatcagcagccaaaacggagctatctgcctggacattctaaaggatcagtggagtccagcgctgacgctaaagactgcgctactgtcgctacaagcgctgctttcgacgccggagccgggggaccctcaagacgcggtcgtcgcaaagcagtacctgagtgagtatccggttttcgagagcactgcgagatactggaccgaaacgtttgcaaagagatcgtcccttggcatggaagaaaaggtagcgaagctagtcgagatgggatttacggatgaggttgcgaccgctgctctagagtgctgtggcggcgacgagaatg

SEQ ID NO: 2038 - DNA, 752 bp, Artificial
  Synthetic
aagcctcttcgaccaccctctgccatcgtcagccttcgactctcttcaccaaacctcaacaagcgacaaattatcgccagggtgctccaacgctcgctccgccatcgccagtatcctttggacccatactttcgctctacaacacacacaacccctcttacgcccacatagcttcggctacgtcaagtttcggcatcatgtctagcagagatcgccgtataatgaaggagctgcaggatctgaccgaggacaaggacacttccggcattcatgctgccctagaacaagagggctcgctgaccgctctcaagggctggttctttggccctggaaatacgccgtacgctggtggcaaattcgtgattcacattcagcttcccaccgactaccccttcaagccacccaagatgaagtttgagaccaggatctggcatcctaatgtcagcagtcagacgggcgtcatttgtctcgacaccctcaacaagaactggtcgcctgtccaaacgatcaagacggctctcctctccgtccgaatgcttctcgaaaacccaaacccctcagatccacaggacggcgaagttgcacggatgctgctcgacagtcccgactcgtttgtccagatggctcacgagtgggcagtcaggcacgccggtgcgccgcgacagcgaaacctcgacgtaactatattcagaagcctggccagaccaacaactgctgtcgatgcgagccgataccatggatacaagccagtc

SEQ ID NO: 2039 - DNA, 622 bp, Artificial
  Synthetic
cccatcccatcccatcttccaaaccacatcatcaatctctaagcgttgcccattatgaagagcgctttgatcgccgccgcggcgcttgttggctccgcccaagctggcgtccacaagatgaagctgcagaaggtctccctcgagcagcagctggagggttcaaccatcgagtcccaggtccagcagctcggccagaagtacatgggcatccgccctactagccgtgccgatgtcatgttcaatgacaaggtgcccaaggtccagggcggtcacccagtgcccgtcaccaacttcatgaacgcccaatacttctccgagattaccatcggtactccccctcagaccttcaaggttgtccttgacactggaagctccaacctttgggttccctcccagtcgtgcaacagcattgcctgcttcctgcattccacgtacgattcgtcctcctcgaagacgtacaagcagaatggatccgacttcgagatccactacggatcaggcagcttgactggcttcatctccaatgatgtcgtcaccattggtgacctcaagatcgagaagcaggactttgccgaggctaccagcgagcccggccttgcctttgctttcggtcgcttcgacg

SEQ ID NO: 2040 - DNA, 410 bp, Artificial
  Synthetic
acgcgcatcattatgccggcatgggcccggggtctgaccctcaccatttccgagaccagagcgtgccgcatttcgacaaggcgggccatacgcggacgcacgagcgggaggatcaccggcggtggcagcggcagagaagggctgtgggggatgatggcatagagtttgagccgcagacgagcctggccgggcactttttgattgtggcggggatattggcggcgacgctgtttgtgccggcggtgtatttgcagtttatgcgcctggggaggcagaagaaggagaaggagtcgtgaggcgggtatggcgtctggagtgtgatagggaaggctgtacaaagaatagagcagacttatatagaaataggcaatgggggggcatgagcgaacaatgccgattttaacgttacg

SEQ ID NO: 2041 - DNA, 248 bp, Artificial
  Synthetic
acaaacaacactgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaact

SEQ ID NO: 2042 - DNA, 606 bp, Artificial
  Synthetic
aaaatcattaagttaaggtggatacacatctgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttgtccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctggg

SEQ ID NO: 2043 - DNA, 616 bp, Artificial
  Synthetic
gccagtacgaacgaacattcagccttgtgcaggggaagcagaagatcatatagagcatttatcaagcgaataacagaccctgagacactgaatcagagaagctttagaagctcttcttctctctgtctccgcgcctcttatcgcaaacagcccctctactgctgctgctgcctttgtcaggcctgtcttttcagtgtcgcatgccccgcctcatctttctaccttgcacaactcagcctttgcgctaatcaacgacatctgcgatctgtgtcggcagcagaagagtcccagatcactggtctctcttttattctccttcttctaaacagatctgtgttgcccccaaagcaagcgagaatacgtcaagatggctcttccgaaacgcatcatcaaagaaaccgaacgccttatggcggaaccagttcccggaatcagcgccgtgcctcacgaagataacctgcgatactttgacgtcgagatccacggccctgcatcgtcaccatacgaaggcggcattttcaagcttgagctcttcctcccagatgactatcccatgactccgcccaaagattcgattccttactaagattttccacccaaacgttgacaagctggg

SEQ ID NO: 2044 - DNA, 573 bp, Artificial
  Synthetic
gtctgtaagaggttgcattgtcagtcaggatctctctgtcttaaaccttgtcattgtcaagcaaggagatcaggacttgccggggttgacagatgttgagaagccaagaatgagaggtccgaaaagagcctcaaagattcgaaagctattcaatctctccaaggaggatgatgtgcgtagatatgttaacacataccgtcgaacgttcactaccaagacaggcaagaaatgcagcaaggcaccaaagatccagaggctggttactcctctaactttgcagaggaagagaagaagaattgctttgaagaagaagagagaggcaaaggcaaagactgaagctgctgattatcagaagcttctggcctcacgcctcaaggaacaacgagaccatagaagtgagtctcttgccaagaagagggcaacccgggtttccgtcgcctctaaatcttctgcttgaattgctacttgcataggataatgctagtcagacttggagtgcattgttatactgaggggaatgcttgtttttcagggagagttgaatagaattagactataaattgtcttattctt

SEQ ID NO: 2045 - DNA, 588 bp, Artificial
  Synthetic
gcagcttccacacgccatcgagacgccgccgtcaaaaccgccgtcaaaatgaagctcaacatctcctaccccaacaatggaacccagaaattgatcgaggtcgaagatgagcgcaagctccgcgtcttcatggaccgccgcatgggtcacgaagtgcctggcgacagtgtcggcgacgagttcaagggctacatcttcaggatcacgggtggcaacgacaaacaaggtttcccgatgaagcagggtgtcatgcaccctacccgtgtccgcctcctcctcagtgagggccactcctgctaccgtccccgccgcaatggcgagcgcaagaggaagtcggtccgcggatgcatcgtcggcatggacctctctgtcctcgctctgagcatcgtcaagaagggcgacgaggacgttcccggtcttaccgacgtcgtccaccccaagcgtctcggtcccaagcgcgcgaccaagatccgccgcttcttcggtctcagcaaggaagatgatgttcgcaagttcgtcatccgccgtgaggttaccagcaagaaggagggtgcgaagccctacaccaaggcccccaagatccaacgt

SEQ ID NO: 2046 - DNA, 658 bp, Artificial
  Synthetic
cgagcgaaccctagctctagcgccgccgccgccgccgccaggaagttcaacatcgccaacccgaccaccgggtgccagaagaagctcgagatcgatgacgaccagaagctccgggcattttatgacaagaggatctcccaggaagtcagtggtgatgctcttggcgaagaattcaagggctatgtattcaagatcatgggaggctgtgacaagcaaggtttccccatgaagcagggtgtgcttacttctggacgtgtccgccttctcctccacaggggtaccccctgcttccgtggatatggcaggcgtgatggtgagcgcagaaggaagtcagtccgtggttgcattgtcagccaagatctctctgttatcaacttggtgattgtaaagaagggtgataatgaccttcctggcttgactgacactgagaagcccaggatgaggggacccaagagggcatctaagatcaggaagctgtttaaccttgccaaggatgatgatgtccgcaagtatgtcaacacttaccgcagaaccttcactaccaagaacggcaagaaggttagcaaggctcctaagatccagaggcttgtcactcccctgactcttcagaggaagagggcgagaatccgccagaagaagcaaagaattgccaagaaga

SEQ ID NO: 2047 - DNA, 639 bp, Artificial
  Synthetic
tggtctttgttctttgctggggggcttaggagggttgccaaggcagggcacagggctgggaagaaatgaagctcaacattgcaaaccctacgacagggtgtcagaagaaggtggagattgatgatgactcaaagctccgtactttttatgacaagcggttgtctcaggaagttagcggtgatgcccttggcgaggagtttaagggttatgttttcaaaatcatgggagggtgtgacaagcagggcttccccatgaagcaaggtgttttggtgcctggccgagttcgccttctcatgcacagaggcacaccatgcttccgtggtcacggaaggcgcaatggagagcgacgccgtaagtcagtaagagggtgcattgttagccaggacctctcctgtcttaaccttgttattgtcaagcaaggtgagcaggacttaccagggttgactgatgtggagaagcccagaatgcgaggcccgaaaagagcttctaagattcggaagcttttcaacctctcaaaggacgatgatgtccgccgatatgtcaacacatatcgccggacttttaccactaaaacaggtaagaagtgcagcaaggcgccgaagattcaaaggctggtgacgcctcttactctgcagagga

SEQ ID NO: 2048 - DNA, 549 bp, Artificial
  Synthetic
gaagctgcgtgcattttttgacaagaggatctctcaggaggtcagtggcgatgctctgggcgaggaattcaagggctatgtcttcaagatcatggggggttgtgacaagcagggtttccctatgaagcagggagtgctcactgctggacgtgtccgccttcttcttcacaggggcacaccttgcttccgtgggtatggcaggcgtgatggtgagcgcaggaggaagtctgtccgtggttgcatcgtcagccaggacctatctgttattaacttggtgattgtcaagaagggtgagaatgacctgcctggccttactgacactgagaagcccaggatgaggggacccaagagggcctccaagatcaggaagctcttcaacctttccaaggatgatgatgtccgcaaatatgtcaacacctaccgcaggacattcactaccaagaatggcaagaaggtgagcaaggctcctaagatccagcgtcttgtgactcccctcaccctccagaggaagcgtgccagaatcgctgacaagaagaagaggatcgccaa

SEQ ID NO: 2049 - DNA, 638 bp, Artificial
  Synthetic
agagaggagctcagcgtaaaatttgagagtttcattgtcagcttggcggcctccactgagttcgaccgaaaatgaagttcaacattgcaaatccgacaactggatgccagaagaagctcgagatcgacgatgaccagaaactccgggctttctttgacaaaaggatctcccaggaggttgctggagatgctttgggagacgagttcaagggatatgtttttaagattatgggaggatgtgacaagcaaggtttcccaatgaagcagggagtgttgactccaggccgtgttcgtcttctgctgtacagaggtactccttgtttccggggctatggtaggcgaaatggggagcgcagaaggaagtctgtccgtggatgcattgttagtcctgatctttctgttctgaatttggttattgtgaaaaagggtgagaatgatctgcctggactgacagacaccgagaaaccaaggatgagaggacccaaaagggcttccaagattaggaagctcttcaacctttccaaggaagatgacgtcaggaagtacgtcaatacctaccgtcgaaatttcacaaccaaaactgggaaaaaggctagcaaggctcctaagatccagaggctggtaacaccattgactctc

SEQ ID NO: 2050 - DNA, 100 bp, Artificial
  Synthetic
gatattcttatgtgtgttcgttcaagagtgtaatgataatactgtttggtaaatggtggaattttggtggtgtgtagatgtgataaccgtaaggtggacg

SEQ ID NO: 2051 - DNA, 580 bp, Artificial
  Synthetic
ggggagcggctctccctgacattcattccaccatggcgcgccgccagcatctcacagcgtccatcctgttggtcgtcgtcctgttcttcagcttctcgtatttcctgtccggctcgtccagccacgatgtggaccgaatccatgagcctgcgggagagcccaagtcggaattcaaagtggacctgggtggcatgccagctagtctgcttgacggagagtctatagcccccaagctggagaatgcaacactcaaggccgagctgggtcgtgcaacatggaagtttatgcacacaatggtcgccagattccccgagcagccctcaaaggaagagcgtaagactctcgagacgttcatctacctcttcagccgcctatatccctgcggtgactgtgcgaggcacttccgggggctgctgtcaaaataccctccccagacgagcagtaggaatgcggcggctggatggctgtgctttgtgcataaccaggttaacgagagactgaagaagccgatatttgactgcaacaacattggcgacttttacgactgcggctgcggagatgaagataagaagaaggggga

SEQ ID NO: 2052 - DNA, 575 bp, Artificial
  Synthetic
acacccattcactgtcgatagccagacccgagacagtaccagtcgccgccatttcaaccaactcatcacgtgataacacatcatccccccacctcacccctaccaacaataagagctctgtaaaaccacaaagctctaacacacctcaagacaacaccccataccagcacagacctacactacaatggcagcacagcgagcgcgaaaaatcgccgtggtaggctcccgagccgtcggcaagtcatccatgaccgtgcagttcgtcgagcagcatttcgtggagtcgtactaccccacaatcgaaaaccagttctccaagaccattgtgtacaagggcattgagtataacacggagatcatcgacacagcaggccaggatgagtttagtatcatgaaccagaagcatctcctgggtgtccatggatacctactggtgtactcggtcacttcacgatccacctttgacgtgctgcccatcatccacgacaagattctcaacgctacaggctcgtcgtcaatcccgctggtcattgtaggcaacaagtcagatctagactcccagcgacaagtgtctg

SEQ ID NO: 2053 - DNA, 931 bp, Artificial
  Synthetic
caatcatcagtcaaactccaaacgaggtatgtatggccttggtcaccgctgacggcgattcggacctggcaggatgacgccttttatcgtggctggggacagcaatcgaagacgccggccccgatgagcgacaatgaacgcgcgatgatgcatcacatcacatcatgcggttttctgtttggcacacaacggctttggctggcgtttctcgatacgctgcttccccttcggcaatgagcgggctgaaccctcgtcgacggatcgctgagggcactctccacgcttctgggccactcctagtctaacatgtgtttcccttctggcagatacctcatttccaactccgacttgagaatctccttttcatcaataccgccaagatggtccgcacttccgttctccacgatgccctcaacagcatcaacaacgccgagaaggccggcaagcgtcaggtcctgatccgacctagctccaaggtcattgtcaagttcctccaggtcatgcagcgccacggctacattggcgagttcgaggaggtcgatgaccaccgctccggcaagattgtcgtccagctgaacggccgtctcaacaagactggtgtcatctccccccgctacaacgtccgcctggccgacctcgagaagtgggtcgtcaagctgctgcctgcccgtcagttcggctatgtcatcctcaccacctctgctggtatcatggaccacgaggaggcccgacgaaagcacgttgccggcaagatcatcggcttcttctactaaaaaaattggcggagagaggaatgaaaaaaaagtgaatttgtggcattctcggcgttccaatggtggtcgcggtgacggtaatcagcatcctctgatttacagctgggatagtcaccctttagcttagcgtacactggcaataaatcacagatgagaag

SEQ ID NO: 2054 - DNA, 669 bp, Artificial
  Synthetic
  misc_feature (322)..(322): The residue at this position can be any nucleotide.
cactttcattttaggtcttcagcgccaaaaataaatagaaagaaaaatggaaggtaaacatgtatcaactcatccagaagttccaggtgaaccaacgaagacaggaacagcaattcttgaaacagcaactgctactattcaaggctttggtcctatcaacaagattcatcagcacctttgcgcgttccatttctatggacatgacatgacacgacaagtcgaggcacaccacttctgcggtcaccaaaatgaagaattcaggcagtgtctcatctacgacaggccagacgctgatggccgcctgattgggctcgagtacatngtttcagaggaactgttcttaacattaccagatgatgaaaagaaattctggcattcccatgagttcgaggtgaaaagtggtgtactcttcatgcctggcattcctggtccgattcaacgacaagatctcgaaaaagttgctaaaacctatggcaaggtcatccatttctggcaggtagatagaggtgacacactccccctaggaattcctcaagttatgatggcactcactagagatggtcagctctatgacaatcttgctcaagatatggagaaacgttatggagtatcatttgctgaagaaagagagaagagggcaaatatggaagggttagctcatggaataca

SEQ ID NO: 2055 - DNA, 887 bp, Artificial
  Synthetic
gagaagaggaaaggaagaatggctgctgctgggccgggacctgtggcgacgaaggactatctccctggcagggagaaggagaccaagagcaagatcttggagaccacagcttcggtgctccagggcttcgccccgatcaagaagatccatcaacacctttgcgcgtaagttctctatgcctttgcatgcaagacctcttcgttcttgttgtttcgcttgatccagcttccactgctatggaaacaacttgagccgccaagtcgaagctcaccactactgcggccatgtaaacgaagacctgaggcagtgcgccatctacgacaccgatgccgcagatgcgaggctcatcgggatcgagtatctcatctccgagtctctcttccggggcctcccggacgaggagaagaagctctggcactctcacgagtacgaggtgaagagcggcatcctcttctgtccggggctgccggaggttgccgagcatgccgagctttccaaggttgccaagacgtatggcaagacgttccacttctggcagtttgatcgcggtgacgcgctgcctctgggacctccgcagctcatgatgtccttcacgaacgacggtcaggtcaatgaaggcatggcaaaaggtaagataatcgactaccttctcccttcttaactttgcgattgtttagtcgtcgaggaacggtatggtgtctcgtttgaggccaagaggaagaagcgagctgacatcgaaggaccggatttcggcattgatcctcaggctgactactggcagaagggaaaaggcttcgagactgttgtcaaggagatggtgtagtctgtaaagttccaactgttagttccaggaaaataaagtcatgatggtagaactacggttgttt

SEQ ID NO: 2056 - DNA, 239 bp, Artificial
  Synthetic
ggttaatttcggattgccacagaataggagacttgccactccggtggttattctcggcatatatgcgacgttagaataacctgtttaatcgtatatagtcactgtgaaggaatccatgagggcaatgttgatgaatgttgtcagtgaagttggaagtatagaacttagccggctacaaacttaaagagcgttgcccaaaatgaagccctatccattccaattcaacagcacatcctcgt

SEQ ID NO: 2057 - DNA, 956 bp, Artificial
  Synthetic
tggtatcaacgcagagtgccattacgccggggactcacaacagaaatagctactaaacaaacagcaaaagataaccagaaaagatggcgactttccctgttgttgatttggggttgcttcaaactgggaaaagggctgaaacattggataaaatcaaagatgcatgtgaaaactggggtttctttgagcttgtgaatcatgggatttcccatgaagtgctggacacagttgagaagcttactaaggagcattacaagaaatgcatggagcaaaggttcaaggaaatggtggcaagtaaaggtcttgaggctgtccaaactgagattgatgatctggattgggaaagcactttttacttgaaacacctccctgtttccactgtgtatgaagttccagacttagaggataaatacagaaatgttatgaaagacttcgcgttgagtctagagaaactagctgaagatcttcttgatttgctgtgtgaaaatctcgggctcgagcaaggttatttgaagaaagcattttatggttcaaagggtccaacttttggtaccaaagttagcaactatcctccttgccccaaaccagaactgatcaaaggcctacgtgctcacactgatgctggtggcctaatcctgcttttccaagatgacaaagtcagtggtcttcagttactgaaagacggtaattggattgatgtcccacctatgaaacactcgattgttatcaaccttggcgaccagctggaggtcataacaaatggaaagtacaagagtattgagcacagagttattgcacaacaagatggcactagaatgtcaattgcttcattttataatccaggaagtgatgctgtgatatttccagcaccagaattggttgaaaaggcagaagaagagaacaagttgaagtatcccaaatttgtgtttgaagattacatgaagctgtatgcaggt

SEQ ID NO: 2058 - DNA, 319 bp, Artificial
  Synthetic
tacgccggggactcacaacagaaatagctactaaacaaacagcaaaagataaccagaaaagatggcgactttccctgttgttgatttggggctgcttcaaactgggaaaagggctgaaacattggataaaatcaaagatgcatgtgaaaactggggtttctttgagcttgtgaatcatgggatttcccatgaagtgctggacacagttgagaagcttactaaggagcattacaagaaatgcatggagcaaaggttcaaggaaatggtggcaagtaaaggtcttgaggctgtccacactgagattgatgatctggattgg

SEQ ID NO: 2059 - DNA, 739 bp, Artificial
  Synthetic
aaacagcaaaagataaccagaaaagatggcgactactttcccagttgtggatttggggttgcttcaaactgagaaaagggctgaaacaatggataaaatcaaagatgcatgtgaaaactggggtttctttgagcttgtgaatcatgggatttcccatgaagtgttggacacagttgagaagcttactaaggagcattacaagaaatgcatggaacaaaggttcaaggaaatggtggaaagtaaaggtcttgaggctgtccaaactgagattgatgatcttgattgggaaagcactttttacttgaaacatcttcctgtttccactgtgtgtgaagttccagacttggaggataaatacagaaatgtaatgaaggatttcgcgttgaagctggaaaaactagctgaagatcttcttgatttgctgtgtgaaaacctcgaactcgagcaaggttatttgaagaaagtattttatggcttaaagggtccaacttttggtaccaaagttagcaactatcctccttgtcccaagccagaactgatcaaaggcctacgcgctcacactgatgctggtggcctaatcctgctggttcaagacgacaaagtcagtggtcttcagttactgaacgatggcaaatggattgatgtcccacctatgaaacactcaattgacatcaaccttggcgaccagctcgaggtgataacaaatggaagatacaagagtattgagcacagagttatt

SEQ ID NO: 2060 - DNA, 681 bp, Artificial
  Synthetic
gtccgggagattccggtgattgacttagtaagcttgacggcgaggagagaagtgcaaccatggcacttctccatacgcttgtgagaaatggggcttctttatgatagagaaccatggaattgacactaacctgatggacaatgtgaagcagctcgtgattcagcactatgaagccaatatgaagaaacggttctatgaatcagagctacctatgagcttagagaagaaagaaaaactcagcaacacagactgggaaagcaccttctttctttggcatcgtccaagttctaacatctatgagattgaaggtctctcaaaggatctttgcaacgcagtagatggatacattgatcagctgattaatcttgctgaaaatctttcagaactaatgtgtgagaaccttggcctagagaagagttacattaaggaagcattttcaggaagcaagggtccttctgttggaacaaaagtggcaatatatcctcaatgtacgcgccctgaattagtcaggggattgcgtgagcacacagatgctggtggtatcattctcttactccaagatgaacaagttcctggtctggaattctttaaagatggacattgggtgaaaattccaccttccaagaacaacagaatttttgtaaacactggtgatcaaatcgaaattttaagcaatgggat

SEQ ID NO: 2061 - DNA, 507 bp, Artificial
  Synthetic
gacacacagacgcactcacacactcagctgaagcgagcgagcgagtgaacgagagagagagacagagatggcgagtgttgcctccttcccggtgatcaacatggagaacctggagaccgaggagaggggcgcagcaatggaggtcatccgcgacgcctgcgagaactggggcttcttcgagatgctgaaccatggcatcgcgcacgagctgatggacgaggtggagcgggtgagcaaggcgcactacgccaactgccgggaggagaagttcaaggagttcgcgcggcggatgctggaggccggcgagaagggcgccgacgtgaagggcatcgactgggagagcaccttcttcgtccgccaccgccccgtctccaacctcgccgacctccccgacgtcgacgaccactacaggcaggtgatgaatcaatttgcgtcggagatcgagaagctctcggagagggtgctggacctgctgtgcgagaatctgggcctggagaagggttacct

SEQ ID NO: 2062 - DNA, 487 bp, Artificial
  Synthetic
aattcggcaccaggaaattttgagagtttcccagtggttaacatggagttgcttaacactgaacaaagggctgcaacaatggagaaaattaaggatgcttgtgagaactggggcttctttgaggtggtaaatcatgggatctgtcatgagcttctggacacagtggagaagttgacaaagggacactacaagaagtgtatggaacaaaggtttaaggaaatggttgcaagtaaagggcttgaagctgttgagactgaaataaaggatttggattgggaaagtactttcttcttgaaacaccttcctgtttcaaacatctcagaagttcctgatcttgaagatgaatacaggaaaatcatgaaggagtttgctgaaaagctagagaaattagcagagcaacttttggacttgctctgtgaaaatctaagactggagcaaggttacttaaagaaagccttttatggttcaaatggtcctacttttggca

SEQ ID NO: 2063 - DNA, 575 bp, Artificial
  Synthetic
cacaacccagctggtgaaagagaggaacttgagagttagctagcatggcggcagcattgtcgttcccgatcatcgacatgagtctgctcgacggggcagagaggcccgcggcgatggggctgctccgcgacgcatgcgagagctggggcttctttgagatcctgaaccacggcatctcgacggagctgatggacgaggtggagaaaatgaccaaggaccactacaagcgtgtgcgcgagcagaggttcctcgagttcgcgagcaagacgctcaaggaaggctgcgacgacgtgaataaggcggagaagctggactgggagagcaccttcttcgtccgccacctcccggagtccaacatcgccgacatacccgacctcgacgacgactacaggcgcctcatgaagcgcttcgcggcggagctggagacgctggcggagcggctactggacctgctctgcgagaacctcggcctcgagaagggctacctcaccaaggccttccgtggccccgcgggcgcacccaccttcggcaccaaggtcagcagctacccgccgtgcccgcgccccgacctcgtc

SEQ ID NO: 2064 - DNA, 445 bp, Artificial
  Synthetic
cccccccggcacacacagacacacagacgcactcacacactcagcttaagcgagcgagcgagtgaacgagagagagagacagagatggcgagtgttgcctccttcccggtgatcaacatggagaacctggagaccgaggagaggggcgcagcaatggaggtcatccgcgacgcctgcgagaactggggcttcttcgagatgctgaaccatggcatcgcgcacgagctgatggacgaggtggagcgggtgagcaaggcgcactacgccaactgccgggaggagaagttcaaggagttcgcgcggcggatgctggaggccggcgagaagggcgccgacgtgaagggcatcgactgggagagcaccttcttcgtccgccaccgccccgtctccaacctcgccgacctccccgacgtcgacgaccactacaggcaggtgatgaagcaat

SEQ ID NO: 2065 - DNA, 642 bp, Artificial
  Synthetic
cccgactagattcttaatacacaacccagctggtgaaagagaggaacttgagagttagctagcatggcggcagcattgtcgttcccgatcatcgacatgagtctgctcgacggggcagagaggcccgcggcgatggggctgctccgcgacgcatgcgagagctggggcttctttgagatcctgaaccacggcatctcgacggagctgatggacgaggtggagaagatgaccaaggaccactacaagcgtgtgcgcgagcagaggttcctcgagttcgcgagcaagacgctcaaggaaggctgcgacgacgtgaataaggcggagaagctggactgggagagcaccttcttcgtccgccacctcccggagtccaacatcgccgacatacccgacctcgacgacgactacaggcgcctcatgaagcgcttcgcggcggagctggagacgctggcggagcggctactggacctgctctgcgagaacctcggcctcgagaagggctacctcaccaaggccttccgtggccccgcgggcgcacccaccttcggcaccaaggtcagcagctacccgccgtgcccgcgccccgacctcgtcaagggcctccgcgcccacaccgacgccggcggcatcatcctgctcttc

SEQ ID NO: 2066 - DNA, 1058 bp, Artificial
  Synthetic
aaaatacatagaaagatggagagtttcccagtggttaacatggagttgcttaacactgaacaaagggctgcaacaatggagaaaattaagaatgcttgtgagaactggggcttctttgaggtggtaaatcatgggatctgtcatgagcttctggacacagtggagaagttgacaaagggacactacaagaagtgtatggaacaaaggtttaaggaaatggttgcaagtaaagggcttgaagctgttgagactgaaataaaggatttggattgggaaagtactttcttcttgaaacaccttcctgtttcaaatatctcagaagttcctgatcttgaagatgaatacaggaatgtagggaaaatcatgaaggagtttgctgaaaagctagagaaattagctgagcaacttttggacttgctctgtgaaaatctaggactggagcaaggttacctgaagaaagccttttatggttcaaatggtcctacttttggcaccaaagttagcaactatccaccatgtcccaagcctgatttgattaaaggccttagggctcacaccgatgctggtggaatcatccttctattccaagatgacaaagtcagtggtctccaactgctcaaagacgacaaatggatcgacgttccaccaatgcgccactccatcgtcatcaacctcggagaccaacttgaggtgattactaatggaaagtacaagagtgtggagcatagggtgattgctcagcctgatggaaacagaatgtccctagcttcgttctataacccggggagtgatgctgtcatctatccagcaccagaattgttggagaaagagaacaaagtcatttatcctaagtttgtatttgaggactatatgaaattatatgcaggtcttaagttccaggctaaagagccaaggtttgaagcaatgaaggctgtggaaactactgtcaactctgccccaatagctactgtttgagactttgatggagtattaattagaaaactgattaatgagaagaaaatggcttagtattaagattatgatgatgtattgatgat

SEQ ID NO: 2067 - DNA, 251 bp, Artificial
  Synthetic
aacaaaagttcaatgacatgctcaagtccaaaggtttggataatcttgagacagaagtcgaagatgtggattgggaaagcactttctacgttcgtcacctccctcaatccaatctcaatgacatttcagatgtgtctgatgaatacaggacggccatgaaagactttggtaagagactggagaatcttgctgaggatttgttggatctactgtgtgagaatctagggttagagaaagggtatttgaagaaa

SEQ ID NO: 2068 - DNA, 157 bp, Artificial
  Synthetic
agcaattatacattaaaatcacctcatcacctgcggatactattatgcatattaattactcgaccggcaacagccatcccagcatcctcttttggtaaagtagtggccttcacatgcaaacatcggctatcgcaactaacacccccttcccctgtcc

SEQ ID NO: 2069 - DNA, 606 bp, Artificial
  Synthetic
attctcttggaggcaaaggagagagagagagagagagagagagaggttgcaggttccggtagcaaggaaggcgcaaccatggtggcagcaaagaagacgaaaaaggctcaagagagcatcaacaacaggttagccctggtcatgaagagtggcaaattcactcttggatacaagactgccttgaaatctctccgtggtggcaaagcaaaacttgtcatcatctcgaacaactgccccccactaaggaagtctgaaattgagtactacgctatgctctccaagacaggggtgcatcagtacagtggaaacaatgtggacttaggcacagcctgcgggaagtactatcgcgtcagctgtcttagtatcacagaccctggtgattctgacatcatcaggactgtggagtagggatgagagttcaaaccaagtttagtgtggaagtaggacgtcttttaattcctctgagcatgcaagggggccgagttttgcctcttcactggaatttattgattagcctgttaacctctgcttaaagagaacttggctattttgtagatggctaagtcttgattgatgatgaaatatggtcattgcgttttcttttcc

SEQ ID NO: 2070 - DNA, 587 bp, Artificial
  Synthetic
ggaaaaccctagcaagaagaagaagaagaatattagttccatctctttgccggaagttcaacagagaaggcaatcatggtggccgctaagaagacgaaaaaggcccaagagagcatcaacaataggctagccctagtcatgaagagtggcaagttcactcttggatataagaccacattaaagtctctacgcggtggcaaagggaagcttattattatctccaataactgtccccccttaaggaaatcagaaatcgagtactatgctatgctctctaaaactggagttcatcagtacagtggaaacaatgtggacttaggcacagcctgcgggaagtactatcgggttagctgtcttagcatcacagatcccggtgattcggacattatcagaactgttgaatagagcttagagaggattaaaggcggtaatgcttatcatattagctcatctcgagggggcttctttggaagacttgcatgaatttccctagttttcttttcttgctttattggatcagagaaaccaattaatatatatggctaaattaaacatggaaaattaaatttgtagtagccgactgtttt

SEQ ID NO: 2071 - DNA, 648 bp, Artificial
  Synthetic
ccgacctcgcagtcgccaccccgagcagaagccgccgccgccgcccgaaaccctcgccgccgtcgcttctcctcggggcgcagccatggtggccgcaaagaagacgaataagtccacggacaacatcaacaacaagctgcagctcgtgatgaagagcggcaagtacacgctcggctacaagaccgtcctcaggaccctcaggaactccaaggcgaagctagtgatcatttctaacaactgcccacctcttcggaagtcagaaattgagtactacgctatgttggccaaggtcaccgtccaccatttccacggaaataatgtcgatctggggacagcctgtggtaaatacttccgtgtttgctgcctcagcattattgatcctggtgactcggatatcatcaagaccacgggtgagcagtaaggatgagcggttccgctggcgcttcagatgctgtcacactgagctgttctagacattgtagttgttgctggacttgatttggtctctctcgtgtatcgaacagcttttaccagtcaaccaaagtttcgtgggaacattgttcttggattggaaaattttgttcctggcccgaatcatgttttcaattaaaacgcttggctgtttgttcactgaacttcgcatcatta

SEQ ID NO: 2072 - DNA, 680 bp, Artificial
  Synthetic
gccattacggccggggatataactaacattagaaacctcggccacttccctttccccgttgtttcagagtgtttttatcaacaaaaatggcgacaacagggaagaaaacgaagaagacccatgagagcatcaataacaggttagctctggtaatgaagagtggcaagtactctctcggttacaagaccgttctgaagaccctcaggagctctaaagggaagttgatattgatatctaacaactgcccaccattgagaaagtcagagattgagtactatgctatgcttgctaaagttggtgttcaccatttcaatggaaacaatgttgatcttggaacagcatgtgggaagtatttccgtgtttcatgcctcagcatcattgacccaggtgattcggacatcatcaagtctctacctggtgatcactaagagatattcaccagggttttgctaaaccattttagtgagttgagaaaatctgtactatctttttattcttgtatttcagagttataccaagattatagaggatgttggtattatctagttttgttggttttatcatttctccagaagttttgaggtcaggtacattatgattttattcacagatcaatttccctataccattttgcttttctaaatgagttcactagattttcttgttgttaaaggaaaaaa

SEQ ID NO: 2073 - DNA, 476 bp, Artificial
  Synthetic
ggcgacgaagagagaggagagatccaagatggtggtcgccgggaagaagcagaagaagacccaggagagcatcaacaacaggttggcgctggtgatgaagagcggcaagttcactctgggctacaagacggtgctcaaatcgctgcggagtgggaaaggcaagctcgttctcatctccaacaattgcccgccgctccgcaagtcggagatcgagtactacgcgatgctctccaaaaccaacgtccaccattacagtggaaacaatgtggagcttggtaccgcttgcggcaagtactatcgggtctcttgccttaccatcacagatccaggcgattcggatatcatcaaatccatgtccgccgagtgaaaatccatccatcgatcagcgctcctctgttttgtttcgctgttcaacttcttgtaggcctcttactctagaaatatggaactttaatggaaaaacatttccttcatag

SEQ ID NO: 2074 - DNA, 657 bp, Artificial
  Synthetic
gttatgagatttggaaaaccctagcaagaagaagaagaagaatattagttccatctctttgccggaagttcaacagagaaggcaatcatggtggccgctaagaagacgaaaaaggcccaagagagcatcaacaataggctagccctagtcatgaagagtggcaagttcactcttggatataagaccacattaaagtctctacgcggtggcaaagggaagcttattattatctccaataactgtccccccttaaggaaatcagaaatcgagtactatgctatgctctctaaaactggagttcatcagtacagtggaaacaatgtggacttaggcacagcctgcgggaagtactatcgggttagctgtcttagcatcacagatcccggtgattcggacattatcagaactgttgaatagagcttagagaggattaaaggcggtaatgcttatcatattagctcatctcgagggggcttctttggaagacttgcatgaatttccctagttttcttttcttgctttattggatcagagaaaccaattaatatatatggctaaattaaacatggaaaattaaatttgtagtagccgactgttttgccgtgtcattggtgttgcaagtaaggttctcgtttttgtgccaaaaaaaaaaaacaa

SEQ ID NO: 2075 - DNA, 235 bp, Artificial
  Synthetic
gctggcaacacccctgctctgcgaaagtccgagattgagtactacgccatgctcgccaagtgcaccgtccaccacttccagggcggcaacaacgagctcggtacctcttgtggtcgactcttccgagttggcgccgtcaccatcatggatgccggtgactccgacattctgactgctgagctttcttaagcagtttgaagacccccaaaataaaaattaatgtactttagtgccg

SEQ ID NO: 2076 - DNA, 660 bp, Artificial
  Synthetic
gctaatcgcaagatcgcagctcgcgcccaaaatcagtcaaaatggcccctcagaagaagagcaagaaggatgccaacagcatcaactccaagttggcgcttgttatgaagtccggaaaggtcactctcggctacaagtctactctcaagtctctgcgatccggcaaggccaagctgatcatcattgctggcaacactcctcccctgagaaagagtgaactcgagtactacagcatgctgtccaaggctcccatccaccacttcgctggtaacaacgtaagttttgcaatctcagacgccctggacaagtgaagacctggaaacgggtatatctacttgcgccattacacacttctcgcttctttcagaagctactcttgctacccgagaattgccaattcttgcggaattgcccagagaagaagtctttcagactttggagggttcacattggcttacattattcgtaaaacagattgagctcggcactgcctgcggaaagctcttccgctgctccacccttgccatcctggatgctggtgactctgatatcctcagcgaccagcaggcttaaatagccgaaatctagtgcattcaaaacggcgttgggggtaaaacggttcaagggcaatatggataccatacactttcacattatgtg

SEQ ID NO: 2077 - DNA, 557 bp, Artificial
  Synthetic
cccacgcgtccgccccgagcagaagccgccggcgccgcccgaaaccctcgccgccgtcgcttctcctcggggcgcagccatggtggccgcaaagaagacgaagaagtccacggacaacatcaacaacaagctgcagctcgtgatgaagagcggcaagtacacgctcggctacaagaccgtcctcaggaccctcaggaactccaaggcgaagctagtgatcatttctaacaactgcccacctcttcggaagtcagaaattgagtactacgctatgttggccaaggtcaccgtccaccatttccacggaaataatgtcgatctggggacagcctgtggtaaatacttccgtgtttgctgcctcagcattattgatcctggtgactcggatatcatcaagaccacgggtgagcagtaaggatgagcggttccgctggcgcttcagatgctgtcacactgagctgttctagacattgtagttgttgctggacttgatttggtctctctcgtgtatcgaacagcttttaccagtcaaccaaagtttcgtgggaacattgtcc

SEQ ID NO: 2078 - DNA, 603 bp, Artificial
  Synthetic
ccccgggacctcgcagtcgccaccccgagcagaagccgccgccgccgcccgaaaccctcgccgccgtcgcttctcctcggggcgcagccatggtggccgcaaagaagacgaagaagtccacggacaacatcaacaacaagctgcagctcgtgatgaagagcggcaagtacacgctcggctacaagaccgtcctcaggaccctcaggaactccaaggcgaagctagtgatcatttctaacaactgcccacctcttcggaagtcagaaattgagtactacgctatgttggccaaggtcaccgtccaccacttccacggaaataatgtcgatctggggacagcctgtggtaaatacttccgtgtttgctgcctcagcattattgatcctggtgactcggatatcatcaagaccacgggtgagcagtaaggatgagcggttccgctggcgcttcagatgctgtcacactgagctgttctagacattgtagttgttgctggacttgatttggtctctctcgtgtatcgaacagcttttaccagtcaaccaaagtttcgtgggaacattgttcttggattggaaaattttgttcctggaaaaaaaaaaa

SEQ ID NO: 2079 - DNA, 696 bp, Artificial
  Synthetic
ccggtgatgcagaccttggtccagtgatcagcaaacaggctaaggaacgtatctgcaaattaatacaaagtggtgctgataatggtgctcgtgtgctgcttgatggaagagatattgtggttcctaacttcgagaatggtaattttgttggtccaacactccttgctgatgttaaaagtgaaatggaatgttacaaggaggagatttttggtccagttcttctcttgatgaaggctgagagcctagatgatgctatccaaattgtgaacagaaacaaatatggcaatggagcatccatatttacaacatctggtgtgtctgcaaggaaatttcaaacagacattgaagctggccaggtgggcatcaacgtgccgattccagtacccctgccgttcttctccttcaccggcagcaaagcctcctttgcaggagacttgaatttctacggcaaggcgggcgtgcagttcttcacccagatcaagacggtcacgcagcagtggaaggagtcgccggctcagcgcgtctccctctccatgcccacctcgcagaagtgaggtgaaaaaaaagaaaggcatcttgtacgttcttcatttgcccatccatggaaatagacacatgcaccaatgcgaaatgaacagaagaataatcgataggcgcgggatgccatgccatgccaataaaggtagctggtctcgt

SEQ ID NO: 2080 - DNA, 627 bp, Artificial
  Synthetic
tttcctaccaattcatccctccatataataaaaaccatgtgtggtacagacgcccccgacgccgccgctggtcccgtgtccaacgggtcgcatgccagcaaggccaacccagccagctctccgtatcagaacgtcaacgacttcatctccaatgtcgcccgattcaagatcatcgagagcactcttcgtgagggcgagcagtttgccaatgccttctttgacactgaaaccaagattaagatcgccaaagctcttgacgagtttggtgtcgactacatagagctcacaagtcctgtgtcttctcctcagtcatatgaggattgtaagactatctgcgggcttggcctgaaggccaagattctcactcacgtgcgatgcaacatggaagacgccaagaaggccgtcgagtgtggtgttgacggcgtcgacctcgtcattggtacttccagcttcctacaaaagtacagccacggaaagagtatcgctatcatcaaggagactgccctggaagtgattcagtatgtcaagagccagggcgtagaggtccgcttctcttcagaggactcgttccgaagtgacctcgtcgacctccttactctctacaaggctgtcgatcaggctggagtt

SEQ ID NO: 2081 - DNA, 716 bp, Artificial
  Synthetic
gccattacggccggggacacaaattcacattcaagtcctcacatttctcctactctctctcatatttcatttctctctctagtgtttccacaatggcaccaaaagccgagaagaaacccgccgagaagaagccagcagctgagaaggcaccagtagcagcagctgcagcggagaagaagccaaaggctgggaagaagcttcccaaggacggcgccggagcagctgcaggagacaagaagaagaagaggttaaagaagtctgttgaaactaacaagatctacatcttcaaggtgttgaaacaggttcatcctgatattggtatctctagtaaggctatggggatcatgaacagttttattaatgacattttcgagaagctggctcaggaatcttctagattggcccgttacaacaagaagcctactatcacttctcgggagattcagactgctgtgaggcttgtgcttcctggtgaattggctaagcatgctgtttctgagggtaccaaggctgttactaaatttactagctcttaatcaattttagagtttgtgttttgattagggtttgtagatgtaaagaattgtccaattagggttgcatttgacatttgtggcatgtaatggacatctatattatgaatgaagagttttctgttttctctgacaaaaaagaaacaagaaagaaaaaaaaaaaccatgtcggccgccttggcc

SEQ ID NO: 2082 - DNA, 655 bp, Artificial
  Synthetic
ttcaagtcctcacatttctcctactctctctcatatttcatttctctctctagtgtttacacaatggcaccaaaagccgagaagaaacccgccgagaagaagccagcagctgagaaggcaccagttgcagcaggtgcagcggagaagaagccaaaggctgggaagaagcttcccaaggacggtgccggagcagctgcaggagacaagaagaagaagaggttaaagaagtctgttgaaacttacaagatctacatcttcaaggtgttgaaacaggttcatcctgatattggtatctctagtaaggctatggggatcatgaacagttttattaatgacattttcgagaagctggctcaggaatcttctagattggcccgttacaacaagaagcctactatcacttctcgggagattcagactgctgtgaggcttgtgcttcctggtgaattggctaagcatgctgtttctgagggtaccaaggctgttactaaatttactagctcttaatcaattttagagtttgtgttttgattagggtttgtagatgtaaagaattgtccaattagggttgcatttgacatttgtggcatgtaatggacatctatattatgaatgaagagttttctgttttctttgttaaatttgcttggttatg

SEQ ID NO: 2083 - DNA, 695 bp, Artificial
  Synthetic
agaagcgtcaggaggaactcaaggagaagttcgagggtctgtgcaaggtgatcaaggaggtgctcggtgacaaggtggagaaggttgtggtctctgaccgtgtggttgactctccctgctgtctagtcactggggagtatggctggactgctaacatggagaggatcatgaaggcccaggctctgagggactccagcatggccggctacatgtctagcaagaagaccatggagatcaacccggagaatgccatcatggacgagctccgcaagcgtgccgatgcggacaagaatgacaagtccgtgaaggacctggtgatgctgctcttcgagactgccctgctgacctccggtttcagcttggaggaccccaacaccttcggcaccaggatccaccgcatgctcaagctcggcctgagcatcgacgaggacgagtccgccgaggctgacgccgacatgcctccgctggaggacgacgccggcgagagcaagatggaggaggtcgactaaacgtcatggacccatggatgccattctgtcccttctagttatccctctcctagttctcttctcatagctttctgactgctgctgttcgctttctttttggtacgttggatgcatcagttttgtctttgtcttagctcttaaacaatgcgtggtaccttgtcatactgtttgcgttgcaatgctact

SEQ ID NO: 2084 - DNA, 708 bp, Artificial
  Synthetic
cggacgcgtgggggaatttgagggtaagaagcttgtttctgctgccaaggaaggtctcaaacttgatgaaagtgaggatgagaagaaaaagaaggaagaattgaaggagaaatttgagggcctgtgcaaggtgattaaggatgtacttggtgacaaggtggagaaggttgtcgtttcagaccgtgttgttgactctccctgctgtttggttactggtgagtatggctggactgcaaacatggagagaatcatgaaagcacaagcacttcgggattctagcatggctggatacatgtctagcaagaagaccatggagataaacccagacaatgccatcatggatgagcttaggaagagggctgatgcggacaagaatgacaagtctgtcaaggatttggtcctgttgctgttcgagactgctcttctcacctcgggtttcagcctcgatgatcccaacaccttcggtaacagaattcacaggatgctgaaacttggtctcagcattgatgaggagtccggggatgcagatgttgacatgccagcacttgaggatcctgaagctgatgctgagggaagcaagatggaagaagttgattaagtttttagtctgtagaagttcatttgatattttgttatcacaaaagttccattctcttttaccctacgcataaggggccgtttttgacattagtagttccaattcaatcg

SEQ ID NO: 2085 - DNA, 642 bp, Artificial
  Synthetic
tgctgaactgctgaggtaccactccacaaagagtggtgagagatgaccagcttgaaggactatgtcacaaggatgaaagaaggccagaatgatatttactacattactggtgagagcaagaaggctgttgagaactcacccttccttgagaagctgaagaagaagggctatgaggttctttacatggttgatgctattgatgagtactcagttggtcaattgaaggaatttgagggtaagaaacttgtttctgctaccaaggaagggctcaagcttgatgagagtgaagatgagaagaaaaagcacgaagaactaaaggaaaagtttgaaggtctgtgcaaggtgattaaggatgttctaggtgacaaggttgagaaggtggtcgtctctgaccgtgttgtggattctccttgctgcttggttaccggagagtatggctggactgccaacatggagagaattatgaaggcacaggctctgagggactctagcatggctggatacatgtctagcaagaagactatggagatcaaccctgagaatgccatcatggaagagctcaggaagagagctgatgctgacaagaacgataagtctgtcaaggatttggttctattgctgtttgagactgctcttctcacc

SEQ ID NO: 2086 - DNA, 1150 bp, Artificial
  Synthetic
agagtggctcagctttgtcaagggcattgttgattctgaagaccttcccctcaacatctcacgtgagatgctccagcagaacaagatcctgaaggtgatccgcaagaaccttgtgaagaagtgcgtggagctcttctttgagatcgctgagaacaaggaagactacaacaagttctacgaggccttctccaagaatctcaagcttggcatccatgaggactccaccaacaggaccaagattgctgagctcctgaggtatcactccaccaagagtggtgatgagttgaccagcctcaaggactacgtaacccggatgaaggagggccagagtgagatctattacatcactggtgagagcaagaaggctgttgagaactcccccttccttgagaagctgaagaagaagggatatgaggtcctgtacatggttgatgccattgatgagtacgctgttggtcagcttaaggagtttgagggcaagaagctcgtctctgccaccaaggaaggtctgaagcttgatgagagtgaggacgagaagaagcggcaggaggaactcaaggagaagttcgagggtctgtgcaaggtgatcaaggaggtgctcggtgacaaggtggagaaggttgttgtctctgaccgtgtggtggactctccctgctgtctagtcactggggagtatggctggactgctaacatggagaggatcatgaaggcccaggctctgagggactccagcatggccggctacatgtcgagcaagaagaccatggagatcaacccggagaattccatcatggacgagctccgcaagcgtgccgatgctgacaagaacgacaagtctgtgaaggacctggtgatgctgctcttcgagactgccctcctgacctccggcttcagccttgaggaccccaacaccttcggcaccaggatccaccggatgctcaagctcggcctgagcatcgacgaggacgagtctgctgaggctgacgccgacatgccgccgctggaggacgacgccggcgagagcaagatggaggaggtcgactaagcgccatggttgtcattcggcccccatctcctggagccctagttctctatagctttatctgactctgtgctcttcgccatttttgctatgctggatgtatcggta

SEQ ID NO: 2087 - DNA, 1014 bp, Artificial
  Synthetic
gaggccttctaaagaacctcaagcttggcatccatgaggattcccaaaacaggtctaactttgctgaactgctgcggtaccattccaccaagagcggtgatgagatgaccagtttgaaggactatgtgaccagaatgaaggaaggccagaatgatatttactacattaccggtgagagcaagaaggccgttgagaactcgcccttccttgagaaactgaagaagaagggttatgaggttctttacatggttgatgccattgatgagtattcaattggtcagctgaaggaatttgagggcaaaaagcttgtttctgctaccaaggaaggtctcaagcttgatgagagtgaagatgagaagaaaaagcaggaagaattgaaagagaagtttgagggactatgcaaggtcatcaaggatgttctaggagacaaggtagagaaggttgttgtctctgaccgtgttgtggactctccctgctgcttggtcactggggagtatggctggactgctaatatggaaagaatcatgaaggcacaagcacttagggactctagcatggctggatacatgtctagcaagaagaccatggagatcaacccagagaatgctattatggaagagctgaggaaaagggctgatgcagacaagaatgacaagtctgtgaaggacttggttctcttgctgtttgagactgccctcctcacctcgggtttcagccttgaggaacctaacacctttggcaacagaattcacaggatgctgaagcttgggctgagcattgatgaggattctggagatgcagatgctgacatgccggctttggaggatcctgaagctgatgctgagggtagcaagatggaggaggttgactaagtgcatagtagcttggctgatgttctatggttcccctagtatttccctattttttgttttaccccatcaacgaacagtatgtattacttctttgtgccattttttgagaatggcagttcaatgtagggtataaatttattgg

SEQ ID NO: 2088 - DNA, 695 bp, Artificial
  Synthetic
aagagagagagagagagagagagctcatattggttagggaaaagggagaaggaagaagagagagaatggcgagtatggtggcatctagtgcattgaggacccctgtggtcggcttgggggattcgaacctccgactcagacggagcaaccccacccctctccgctcatctttcctccgacctgtcgcaagaactgttaacccattgggttcgcatggcaatgctcgggtcacctgctttaaccgagattggctccggaaggatctgtccgtgatcggatttggcctcatcgggtggctagcgccttctagtatcccagccatcaatggcgacagcctttcagggctcttctttagcagcatagggacagagctagcccacttcccgaccgggcccgcccttacgtcccctttctggttatggctggtcacatggcattttggtttatttgttgttctaactttcggacaaatcggattcaagggaaggaaggacgcgtactggtaataataataataaatcctttgcgcgatcattgtcagatgctcggcttagaagctagaaaaagaatctgtaactcaatgtagctttcccttctgttgttggctattgtttgattacactatcctttgatagctgcgagggatgatgtcttcttttatgtaatcctgcacttaaaatttgagtttttttcct

SEQ ID NO: 2089 - DNA, 631 bp, Artificial
  Synthetic
ttcacctcttcatacaccaaaatccaagttcaaaatcaagtcaagaaaacaaagcaaaaaaagggaagaaaattaagaaagatggcagcaagaatggcttctacatcaactgttgtaggtttggtcagttcctctctttcttccccaaaaaagacatccctcaactcaggcttcttaaaatcaccagtgacagcaagaaaccctctaaggatcgcccaagcttcaggaggcaaatttacatgctttgagagagattggctgaggagagatttgaatgtgattggatttggtttaattggatggctggcaccttcaagcattccagcaattaatggcaaaagtttaagtggtctcttttttgagagtattggcactgagctctctcatttccctactggccctggtgtcacttctcaattctggctatggatggtctgttggcacctgggcttgttcctctgcctcacttttgggcaaattggattcaaaggaaggactgagaaatatttttaaatggaattttttctgataatttgtgtataatgaagaatcttttaatgtcttaactctcctttctcaatcttcagaatataataggagacaaaccccttctactttttaatacttaaag

SEQ ID NO: 2090 - DNA, 633 bp, Artificial
  Synthetic
ctcgccgaccagggacagagagagaccatctgctagcttagctgccatggccgcctccaccgtctccggcctcgccggcgccaccctcgcccgccggccggccttctccaccggcttcacgacgggcgcccgggtgtcggcgaggaacccgctgatgacgaggaacctggagaggaacggcaggatcacctgcatgacgtttccgcgggactggcttaggagggacctgaacgtgatcgggttcgggctgatcgggtggatcgcgccgtcgagcgtcccggcgatcaacggcaacagcctcacggggctcttcttctccagcatcggccaggagctctcccacttcccctcgccgccggcgctcgactcgccgttctggctgtggttggtgacgtggcaccttgggctgttcctggcgctcaccttcggccagatcgggttcaagggcaggaccgagggctacttcgacaagtgaatgaatccatagtggcttttggttagcttgactgtacggacggatgtgtgcgctgcatatccttccttttgtatagggctctgatttgatcctcttgcggatgtacgctgttgtaattctcctcaactccttaaaactttaaaggacaaatatatgtg

SEQ ID NO: 2091 - DNA, 862 bp, Artificial
  Synthetic
cttttattgctccaagtaaaacaatgtcatatgttatacttggagcaacaaatgggaaataagttatgcaggcgaacagccgatgcagtataataacacaatgatatatgttattatgacagtaaagtcgaaggtatttctgacgctcatagcatgctgaaatgaagggaaaataccaatattaaggaactgaaaaagtattaagagaagcaaaaatggcagcaacaatgtccactgttgtaggcttagttacttcatctctttcttctccaaagaaggcttgcctcagctcaggcttcttgaaatcaccagtgacagcaagaaaccctttaagggtagcacaagcttcaggaggcaaatttacatgtaattttcaaagagattggctgaggagagacttgaatgtgattggatttggtttgattggatggctggctccttctagcattccagtaatcaatggcaagagtttgagtgggcttttctttgatagcattggcactgaactctctcatttccccactggacctgctctcacttctcagttctggctatggttggtgtgctggcacttgggcttgttcatctgcctaacttttggacaaattggattcaagggacggactgaggactatttctcaaagtaaaatattcccttctgaaaatttgtgtataaataagaaatacgctatttcagttccttaatattggtattttcccttcatttcagcatgttatgagcgtcagaaatcccttctactttaatgtcataataacatatgacattgtgttattaaactgcatcggctgtccgcctgcataacttattttccttttattgctccaagtataacatatgaca

SEQ ID NO: 2092 - DNA, 666 bp, Artificial
  Synthetic
cccgacggagacaacacacgcagctcgccgaccagagacagagagagaccatctgctagcttagctgccatggccgcctccaccgtctccggcctcgccggcgccaccctcgcccgccggccggccttctccaccggcttcacgacgggcgcccgggtgtcggcgaggaacccgctgctgacgaggaacctggagaggaacggcaggatcacctgcatgacgtttccgcaggactggcttaggagggacctgaacgtgatcgggttcgggctgatcgggtggatcgcgccgtcgagcgtcccggcgatcaacggcaacagcctcacggggctcttcttctccagcatcggccaggagctctcccacttcccctcgccgccggcgctcgactcgccgttctggctgtggttggtgacgtggcaccttgggctgttcctggcgctcaccttcggccagatcgggttcaagggcaggaccgagggctacttcgacaagtgaatgaatccacagtggcttttggttagcttgactgtacggacggatgtgtgcgctgcatatccttccttttgtatagggctctgatttgatcctcttgcggatgtacgctgttgtaattctcctcaactccttaaaactttaaaggacaaatatatgtgttgtggctaa

SEQ ID NO: 2093 - DNA, 611 bp, Artificial; identical to SEQ ID NO: 1209
  Synthetic

SEQ ID NO: 2094 - DNA, 441 bp, Artificial
  Synthetic
atttatcgagtttcacagggcttacaactcctgtccggggggattggcagatcttgacaactgaggaggaccggatgccgtgacgtgtagctgctaggatgaatcttggattggagatttgccagtcgatttggatggtgcctttcgggatggaggggtggagggtggagagatatgactagtgtggaggtatcacagcgtcggggggctgtggagagttcagggtaagccatttgcggctttcacgctcagtaacactcgggggtttaaaactgactgatggcccatctataccttgcagaamraatttaggtcctcgcaagactctccctagagccgcgtcccgtcactactgctgctttggcatcaaatagtgctcaatggctaggccgagggatttgaagacgatagcaatgtaacccatacgatctgactgaacga

SEQ ID NO: 2095 - DNA, 336 bp, Artificial
  Synthetic
tgaagatttgctttgttttctaagttcakggggtgcaattgagtcttctaaagcgtgctggtgcaacattcaagctgacgttggataaaccttcaaccgtaactcttgtacctctcaagacatcagaatcagatgatggatggattgatgaactgacctgcatctgcccactcaacaatttaatccagtcgagcttctacaacgccaatctcaaagctcacaactctgtattcactcatcttgaccaattctctttcagtttgacctcaatcactctttccctcatgaagaccgacgacgcagtgtcacaaaccaaaaaaataaaaaaaaatgctc

SEQ ID NO: 2096 - DNA, 79 bp, Artificial; identical to SEQ ID NO: 713
  Synthetic

SEQ ID NO: 2097 - DNA, 659 bp, Artificial
  Synthetic
atctagataccctccccttcttcttctcttctttcccccccttcacatttgtgtcttgacgtcgtatttcgcttcagcgtcatcccccatcacacatacacacatagcaacttgccgacgtcatggctgagcaactgagatacgacggccaggtcgtggtcatcaccggagctggcggtggtctgggcaaggcctatgccactttcttcggctctcgaggcgccagcgtggtcgtcaacgacctgggcggcacgttcaagggcgagggaaactctacaaaggctgctgatgtcgtcgtcgacgagatcaaaaaggccggcggcaaggccgttgccaactacgacagcgtcgagttcggcgagcgcatcatcgagaccgccatcaaggcctttggccgcatcgacatcctcatcaacaatgccggcatcctgcgcgacattgccttcaagaacctcaaggacgaggactgggacctcatcatgaaggtccacgtcacgggcgcctacaagtgctcccgcgccgcctggcctcacttccgcaagcaaaagtacggccgagtcatcaacaccgcctcggccgccggtctgtttggcagctttggccagaccaactactctgctgccaagctcgccatggttggcttcaacgagacactggcc

SEQ ID NO: 2098 - DNA, 482 bp, Artificial
  Synthetic
gtttcggaggctgattgagtcggaggggctgccttattgcggcagaggaatagtgacgtcatgactatcaaggaccctggaggttacctaaaagaaaagcatctggacgaggtgacgtagccatcaatgcgatcgattgtttgctctatctcctcgggtcggctgttgatttagtattaaactaatggatatgaatagtgttagagtgtgcgaatggatctcattgtttgaattgatgaatctcggaagatctgagctagctgcaagatgcctcaagccatgcgcaaggcacgtgtggatggaggcaagattggatggagatttactgtaaatcttccaactttaactatagaagggaaagggggaaagaggcgatcgctataccgctggttggattcagctccagggacagatttcatcaaaacaagcgatgaactgtgtggtgacatatatatacgagtacgggtttgatcataattcgc

SEQ ID NO: 2099 - DNA, 561 bp, Artificial; identical to SEQ ID NO: 729
  Synthetic

SEQ ID NO: 2100 - DNA, 301 bp, Artificial; identical to SEQ ID NO: 1705
  Synthetic

SEQ ID NO: 2101 - DNA, 231 bp, Artificial
  Synthetic
atgtggccacgggaatgacgcaaaaggcgccgagagcggaaatggagagaaaaaaaacccaattgcacctcgtgatgatgccactcaaatgtctgtggtcgagccactggcttctacctacgcttacattacctaacaaggaacgaaacattttgcggcaaggagaattggatcattgacttggcgaatgggctaatgaatgtcgtcaattgcaggcctcgtggtttggcg

SEQ ID NO: 2102 - DNA, 563 bp, Artificial; identical to SEQ ID NO: 768
  Synthetic

SEQ ID NO: 2103 - DNA, 214 bp, Artificial; identical to SEQ ID NO: 1721
  Synthetic

SEQ ID NO: 2104 - DNA, 572 bp, Artificial; identical to SEQ ID NO: 788
  Synthetic

SEQ ID NO: 2105 - DNA, 317 bp, Artificial; identical to SEQ ID NO: 796
  Synthetic

SEQ ID NO: 2106 - DNA, 1472 bp, Artificial; identical to SEQ ID NO: 1744
  Synthetic

SEQ ID NO: 2107 - DNA, 668 bp, Artificial; identical to SEQ ID NO: 826
  Synthetic

SEQ ID NO: 2108 - DNA, 470 bp, Artificial; identical to SEQ ID NO: 832
  Synthetic

SEQ ID NO: 2109 - DNA, 624 bp, Artificial; identical to SEQ ID NO: 833
  Synthetic

SEQ ID NO: 2110 - DNA, 542 bp, Artificial; identical to SEQ ID NO: 838
  Synthetic

SEQ ID NO: 2111 - DNA, 595 bp, Artificial; identical to SEQ ID NO: 837
  Synthetic

SEQ ID NO: 2112 - DNA, 784 bp, Artificial; identical to SEQ ID NO: 1751
  Synthetic

SEQ ID NO: 2113 - DNA, 611 bp, Artificial; identical to SEQ ID NO: 1755
  Synthetic

SEQ ID NO: 2114 - DNA, 725 bp, Artificial; identical to SEQ ID NO: 1753
  Synthetic

SEQ ID NO: 2115 - DNA, 617 bp, Artificial
  Synthetic
gttttggagagacggggagctgagatggccgaccagctgacggaggatcagatcgcagagttcaaagaagccttcagtctttttgataaggatggagatggttgcatcacaacgaaggaactggggactgtgatgaggtctctgggccagaatccaacggaaggagagctacaggacatgatcaatgaagtggatgcagacggaagtggaaccattgacttccccgagttcctcaacctcatggcccgcaagatgaaggacaccgactctgaggaggagttgaaagaggccttccgtgtgtttgacaaggaccagaatggatatatctctgccgaagagcttcgtcatgtcatgactaacttgggagagaagctgaccgacgaagaagttgatgagatgatacgggaggcggacgtggacggcgatggccaaatcaattacgaggaatttgtgaagataatgctgtccaagtgaggagaccgaacgggaatacttgggttgtgtgtgaggggactttctcttactcgtagcaattctttcagtatgaaattgagcaactattgccctagtctcttgtaggccttgcattgacttgccttgccttgcaaatcagtaat

SEQ ID NO: 2116 - DNA, 695 bp, Artificial; identical to SEQ ID NO: 827
  Synthetic

SEQ ID NO: 2117 - DNA, 723 bp, Artificial; identical to SEQ ID NO: 1752
  Synthetic

SEQ ID NO: 2118 - DNA, 593 bp, Artificial; identical to SEQ ID NO: 836
  Synthetic

SEQ ID NO: 2119 - DNA, 796 bp, Artificial
  Synthetic
tttctttaaaaacggtcaaagtgccaaaaacgaaatcaaaaggcataaaacttgcgcatagggttctttgaaatcgtgaaaagagagagagagagagaaatggcagagcagctaacggaggagcagatcgctgagttcaaggaggcctttagccttttcgacaaggacggcgatggctgtattactaccaaggaattgggaacagtgatgagatcacttggtcagaatcccactgaagctgaactacaggatatgatcagcgaggttgatgctgatcagaatggaaccattgattttccagagttcttgaatctgatggcacgtaagatgaaggacactgattctgaggaagaactcaaagaagctttcaaggttttcgataaagatcagaatggctttatttctgcagctgagcttcgtcatgtaatgacaaaccttggagagaagctgactgatgaagaggttgatgagatgatccgagaagcagatattgatggcgatgggcaagttaattacgaggagtttgtccgcatgatgcttgccaagtgactttagattctcgtgtattttgcgacggccacttagttacctataacttctagctgtcagtttatattctgtgttgctgttaagacaaacaaatgtgccctatgcttttactagtatctagactcctttcagtttatatgttttaacttccgggctaatggtgtatacagctatagtcccttgcccattcagagggtaaaagaaaaggagaaattagatagtggcattggtaatatcttgttagttg

SEQ ID NO: 2120 - DNA, 624 bp, Artificial; identical to SEQ ID NO: 830
  Synthetic

SEQ ID NO: 2121 - DNA, 654 bp, Artificial; identical to SEQ ID NO: 1747
  Synthetic

SEQ ID NO: 2122 - DNA, 521 bp, Artificial; identical to SEQ ID NO: 1748
  Synthetic

SEQ ID NO: 2123 - DNA, 631 bp, Artificial; identical to SEQ ID NO: 834
  Synthetic

SEQ ID NO: 2124 - DNA, 526 bp, Artificial; identical to SEQ ID NO: 835
  Synthetic

SEQ ID NO: 2125 - DNA, 620 bp, Artificial; identical to SEQ ID NO: 1749
  Synthetic

SEQ ID NO: 2126 - DNA, 701 bp, Artificial; identical to SEQ ID NO: 1750
  Synthetic

SEQ ID NO: 2127 - DNA, 681 bp, Artificial; identical to SEQ ID NO: 1757
  Synthetic

SEQ ID NO: 2128 - DNA, 532 bp, Artificial; identical to SEQ ID NO: 840
  Synthetic

SEQ ID NO: 2129 - DNA, 292 bp, Artificial; identical to SEQ ID NO: 856
  Synthetic

SEQ ID NO: 2130 - DNA, 430 bp, Artificial
  Synthetic
tcgaccattaccatcatacagccaacctctacataagcacaaataccattcaaaatgtcttacggcggtgacaacaacgacaactacggctctcgccgtaatgacgacaactttggctccggaggagattctttcggctctggtggaaaccagcaatatggctccggaggagactcatttggctctgggggagattcatacggctctggtggaaatcaattcggctccggcaaccgccgtaacgatgacagctcatttggtaccagtggccagggcgagttcggctctggaggtaactatggcagctctggcggtgactcctatgggtctggaggaaacacctatggctccggcggcaatgacaactttggctctgggggcaatgatacgtacggctcgtcccgtaaccaagagtcttcttttggatcca

SEQ ID NO: 2131 - DNA, 817 bp, Artificial; identical to SEQ ID NO: 872
  Synthetic

SEQ ID NO: 2132 - DNA, 657 bp, Artificial; identical to SEQ ID NO: 942
  Synthetic

SEQ ID NO: 2133 - DNA, 668 bp, Artificial; identical to SEQ ID NO: 1014
  Synthetic

SEQ ID NO: 2134 - DNA, 374 bp, Artificial; identical to SEQ ID NO: 1031
  Synthetic

SEQ ID NO: 2135 - DNA, 643 bp, Artificial; identical to SEQ ID NO: 1032
  Synthetic

SEQ ID NO: 2136 - DNA, 748 bp, Artificial; identical to SEQ ID NO: 1963
  Synthetic

SEQ ID NO: 2137 - DNA, 594 bp, Artificial
  Synthetic
tactgtcaaatcagatctcttcaatttgctagggttttggtttcttctccctctctgatggcttcgaaacggatattgaaggagcttaaggatctccagaaagatcctcctacctcttgcagtgccggccccgttggagaggacatgtttcactggcaagctacaataatgggccctccagatagcccctacaccgggggtgtatttttagtcactatccattttcctcctgattatccatttaaacctcctaaggttgcttttaggacaaaagttttgcatccaaatattaatagcaatggtagtatatgcttggacatattgaaggagcaatggagccctgccttgactatttctaaggttttgctttcaatatgctcacttttgacggatccaaatcctgatgaccccttggtgcctgagattgctcatatgtacaagacggacagggcaaaatacgaaacaaccgcccggagttggacccagaagtatgccatgggttaaaccgttacctatggcacttgaatttatgtaaaaagaaagaatgcatctgtcctctactttccatacaagaagtatagaatagcattgaac

SEQ ID NO: 2138 - DNA, 846 bp, Artificial; identical to SEQ ID NO: 2010
  Synthetic

SEQ ID NO: 2139 - DNA, 554 bp, Artificial
  Synthetic
gtgtagtcatgtcttcgaagcggattctgaaggagctgaaagacttgcaaagggatccaccaacctcatgcagcgcaggacctgttggggaggatctttttcattggcaagcaacaatcatagggcctgatgatagtccttatgttggtggggtgttcatggtcacggttcattttccccaggactatcccttcaagcctcccaaggttgctttcaggacaaaagtatttcacccaaatgtgagcagcaatgggagcatttgcctagatatcttaaaagagcaatggagtccagctcttacaatatcgaaggtcttgctttcgatttcttcacttcttacggatccgaaccctgatgatcccttggttccggagattgcccacatgtacaagaccaacacggccaagtatgaagccacggccaggagttggacacaaaagtatgccatggggtgagaggcttttcctttgaaagagaaaatggcctttatatattgtttatgtttaaaacctccgttcaaaccttgtattttttttctcaaaatgctacttttt

SEQ ID NO: 2140 - DNA, 648 bp, Artificial
  Synthetic
gggtgccttccttgcgtatcgggaggagaacggaagaatggcttcgaagcggatcctgaaggaactgaaggatttgcaaagggatcctcccacttcctgcagtgcaggtcctgttggggaagatatgtttcattggcaggcaactatcatggggccaactgatagtccttatgccggtggcgtcttcatggtcactattcatttccccccggactaccccttcaagcctcccaaggttgctttccggacgaaagtgttccacccaaatatcaacagcaatgggagcatctgccttgatatattaaaagagcaatggagtccagcccttacaatatcgaaggtcttgctttcgatttgttcacttctcactgatccgaatcccgatgacccccttgtgccggagattgcacacatgtataagacggatcgagccaaatacgaaggtactgcaaggagttggacacagaagtatgcaatgggttgagttgagtctttcttcactcaattgctactcgctcttaatatatcccccccccttgatgtaataaatatatgttggcagacaagttaaaatatcggcatacaaaaagccgtgtttctgaatgatcttgtttcaaaactgaatgaatgcaagcaatgtgtttttat

SEQ ID NO: 2141 - DNA, 643 bp, Artificial; identical to SEQ ID NO: 2034
  Synthetic

SEQ ID NO: 2142 - DNA, 510 bp, Artificial; identical to SEQ ID NO: 1966
  Synthetic

SEQ ID NO: 2143 - DNA, 707 bp, Artificial
  Synthetic
ttcatatatatatatatagagggaggaaggcttcgtgttggaccttccttttttgttttcctttttgccgccatcgccgtctttccttccttccttcgatcgatccatccctcctcctcttcgcgatcaagcttctcctcctccccccccccccaatggcctccaaacggatcctcaaagagctcaaggacctacagaaggacccccccacctcgtgtagcgccggccctgttgcggaagacatgttccattggcaggcaacgatcatgggacctgttgatagcccttacgccggaggtgtgttcatgttgacaatccactttcccccagactaccctttcaaacctcccaaggttgctttcaagacaaaagtatttcatccaaacatcaatagcaatgggagtatttgcttggatattttgaaagagcaatggagcccagctttgacaatctccaaggttttgctttcgatttgttctcttctcactgacccaaaccccgatgatcctctggttcctgagatagcacacatgtacaagatagacagagccaagtacgaatctactgcaaggaattgggcacagaagtatgctatgggctaatagttattataatggacatcccattgcaatggtagacaggccgagggattgattacactttcctgttcttgttttcaaaccatggggggttggatgtatcttgtg

SEQ ID NO: 2144 - DNA, 758 bp, Artificial; identical to SEQ ID NO: 2009
  Synthetic

SEQ ID NO: 2145 - DNA, 671 bp, Artificial
  Synthetic
aaatcccccgtcacccccaacaaaataaaaagagccaaaaaggtcaggaaaaaatcatgtcttcaccaagcaaacggagagaaatggacttgatgaagctgatgatgagtgattacaaggtggaaatgatcaatgacggcatgcaagaattttatgtgcatttccatggacctgctgaaagtccttatcatggtggagtttggaaaatgaaagttgaacttcccgatgcctacccttataaatctccgtcaattggctttgttaataaaatctatcatccaaatgttgatgagatgtcaggctcagtttgtttagatgttatcaatcagacttggagtcccatgtttgatttgacaaacgtgtttgaagtgtttcttccacaacttctcttgtatcctaacccgtcggaccctttgaatggggaagcagctgccttgatgatgcgagaccgaactgcgtatgaacaaagagttaaagaatattgtcaaaaatatgccaaaccagaagatgttggagctgcaccagaggagaagtcaagtgatgaggagttaagtgaagctgaatatgactcggatgatgaggaaatggcaggccccgttgatccataataattccttctatttccattactatctttatatgtaaatgatgttatttatcctgtttaaaat

SEQ ID NO: 2146 - DNA, 679 bp, Artificial; identical to SEQ ID NO: 1964
  Synthetic

SEQ ID NO: 2147 - DNA, 722 bp, Artificial
  Synthetic
cccacgcgtccgatctcttctattcataagttgtaaattcttattattgggattttttccctttttaattcaatccaagaattgagtaggactaatggcatccaggagaattcacaaggaactaagggagttgcaaagagaccctcctacttcatgcagtgcaggtccggtggcacaggatatgttccattggcaagcaaccattataggtccaaatgacagcccttatgcaggtggtgttttccaagtggccatccattttcctcctgattaccctttcaaacctcccaaggtggctttcaagaccaaagttttccatccaaatataaataataatggaaatatttgtttggacattcttaaggatcaatggagtcctgccctcaccatatcaaaggttttgctttccatatgttcactactaacagatccaaatccagatgatccactggttccagagattgctcatatgtgcaagagtgatcggaacaagtatgaatcaatggctcgtagttggactcaaaagtatgctatgaactgagtctgaatacattaagaaaaaactctagtttgtgacaaatatgaatttcttggtatcgagcaatatataaaatgttcaggaaaactggcactcttatgaaaaatgagatgagtgacagttggatgtatttaaatctcgggatttgttttaaataaaagggtgattttactgtcttcttatt

SEQ ID NO: 2148 - DNA, 343 bp, Artificial
  Synthetic
cttctctctaatacgagacagaaaaaggcgaaaacctcgccaatccgattacgcgaaaaatcaaaggtttttggatatggcgtcgaagcggatcttgaaggaattgaaggatctccagaaggatccacctacatcatgtagcgcaggtcctgttgctgaagacatgtttcactggcaggcaacgataatgggtccttcagagagtccttatgctggaggtgttttccttgtaaccatccatttccctccggattacccattcaagcctcctaaggtggcctttaggaccaaggtgttccatcccaacattaacagcaacggtagcatttgcctcgacatcttg

SEQ ID NO: 2149 - DNA, 320 bp, Artificial
  Synthetic
cccacgcgtccgagctcccggtataagtgcctctccatctgaggataatatgcggtatttcaacgttatgattcttggtcctacacaatcaccttatgaaggaggagttttcaagttggagctctttttgcctgaagaataccctatggcagctcccaaggttaggtttctcacaaagatataccatcctaacattgacaagcttggaagaatctgtcttgatattctcaaggacaaatggagccctgcactacaaatacgaacagtgctcttaaggtatatgagctgattacataagattatttcctgctaaaaactat

SEQ ID NO: 2150 - DNA, 522 bp, Artificial
  Synthetic
ggataataaagaggtgaagtaatgtttttgtttgagattaaagaggtttcaaacaaagagatgataaaacataggaatctaacttatttcatggaagatccctatgtgaagaagtcctctctctttctctctctctctctattaaaaccgagtctgtgagggatcaaaggacacaaactttcatcccattgcatatttctgagtccagcttctcgcagtagactcatactttgctctatcggttttgtacatgtgagcaatctctggaaccaatggatcatctgggtttgggtccgttaacaatgaacatatcgaaagcaaaaccttcgatatggtgagtgcaggactccattgttctttcaaaatgtcaaggcaaatgcttccattgctgttgacattagggtggaacacttttgtcctgaatgcaacctttggtggtttgaaaggataatccggagggaagtgaatggttacgagaaagacaccgcctgaataaggactatcaaatggacccattattgg

SEQ ID NO: 2151 - DNA, 541 bp, Artificial; identical to SEQ ID NO: 1061
  Synthetic

SEQ ID NO: 2152 - DNA, 428 bp, Artificial
  Synthetic
cccgggacgacccacgggggcgggatattgaaagaattgacggatttgctaagagaccctcctgttgggggaccaatcaaaaccagaccacaagatatgtgccactggcaagctactataatgggtccgaatgaaagtccttactccggaggtgtcttccttgtcaatattcatttccctgctgattatccttttacacctcccaaggttgtattcacaaccagagtgtttcacgcaaacatcaacattcttggaaacatatgtttggacattctcaaagaccaatggagccctgcccttaccatttctaaggtttgaaattctatatatgtatttagttatttgcatgtcgcctgttaaggcttctttggacagagctccaggtttgtcaatcttgtccccaagaacgagaagagggataccattag

SEQ ID NO: 2153 - DNA, 611 bp, Artificial
  Synthetic
atgcttatattcaggtccgagttttatttgcagtctcgttccaactcttctctctcccacaaagtgaagtcggtctgagattcgtaatggcttcaaagaggattcagaaggaactgaaggacttgcagaaagacccccctgcttcttgcagtgcaggtcctgttggtgaggatatgttccactggcaagctacaattatgggtccatctgacagcccattttctgggggtgttttccttgtgtctatccatttcccccctgattatccattcaagcccccaaaggtttcctttaaaaccaaagtattccatccaaacatcaacagtaatggtagtatttgtctggacatcttaaaagaacaatggagccctgcccttactgtatccaaggtgctgctttccatttgctccttgcttactgatccaaatccagatgatccgttagtgccagagattgctcacatgtacaagactgatagagtgaagtatgagagtactgctagatcttggacccagaaatatgccatgggatgaaaacatttggcttactcccatgaacatcgggcctttatgctatagtagtaaataaaaataggcgcggaacacaatttc

SEQ ID NO: 2154 - DNA, 627 bp, Artificial
  Synthetic
agaaatcgagtaggaggatctctgagggatatggcatccaagagaattctgaaagagctcaaggatctgcagaaagatcctcccacctcttgtagcgctggcccagttgctgaagatatgtttcactggcaagcaacacttatgggtccatctgacagtccttatgctggcggagtgtttcttgttaccattcattttccacctgattatccatttaagcctccaaaggtagcttttaggacaaaagtttttcacccaaacatcaacagcaatggtagcatttgcctcgacattttgaaggaacagtggagcccggcactcacaatatctaaggtgttgctgtccatctgttctcttctaacagacccaaatcctgatgatcctttggtgcctgagattgctcatatgtacaagactgataaaagcaagtacgaagccactgctcggagctggactcaaaaatatgccatgggttagttgctgaaacacaaatatttggcttttatctatgatgtattaagaaattgtgttatgcataattaactcaagggaaaggttgaattgtggccctctgtaaaacacttaattttcctcatgtttgtaagattaaatggttttgaaattctg

SEQ ID NO: 2155 - DNA, 692 bp, Artificial
  Synthetic
gaatttcaattctcgctaatcaggctaagactcagatttcttcgattgtttggtttttaatggcttcgaaacgaatattgaaggagctgaaggatctccaaaaagatcctcctacctcatgcagcgccggtcctgttggagaggacatgtttcactggcaggctacaataatggggccctctgacagcccttacgctgggggtgtatttttagtcactatccattttcctccagattatccattcaaacctcctaaggttgcttttaggacaaaagttttccatccaaatatcaacagtaatgggagcatatgcttggacatactgaaggagcagtggagccccgccttaactatttccaaggttttgctttcaatctgctcacttttgacggatccaaaccctgatgacccccttgttcctgagattgctcacatgtacaagacagacaaggccaaatatgaagcaaccgccaggagttggacccagaagtacgccatgggctaactattgcctatggcggcttgaattgatataaagaaaaacaaatttcaatgtctttcttctctgttctctccattaacaagttgtacaatagcattaagcattgccctctgcaggaagaattatgatgctttaaattttgtttatatggattctaatatttgatgtggggaagcatatatttatctg

SEQ ID NO: 2156 - DNA, 764 bp, Artificial
  Synthetic
aaattattgggggtagctgaaaatacctagcaaagatacataacggaccaacggtatactgtcacgacatatctgcttataaaaaaggagtcctaatttcactgtaaacttctcgctttctcctcggtcccctccagaatctgaattgcaacgtgtaggaggatctctgaaggatttggtgaatcatggcatccaaacggattctcaaagagctcaaggatctccagaaagatcctcctacctcttgcagcgctggtccagttgctgaagacatgtttcattggcaagcaacaattatgggtccgcctgacagcccttatgctggcggagtgtttcttgttaccattcattttccacctgactatccatttaagccaccgaaggtagctttcaggacaaaggttttccacccaaacatcaacagcaatggtagcatttgcctcgacattttgaaggaacaatggagtccggcacttacaatctccaaggtattgctgtcaatctgttctctgttgacagaccctaatcctgatgatccattggtgccggagattgctcatatgtacaagactgataaaagcaagtacgaaacaactgcccggagctggactcaaaagtatgccatgggttagttgcagtgaccatctctggaggggctccttttcttctgtggtattctgtatatctattatgtattaagaaatggtgttcttatgcataatcaactcaaggggaaatgttgaacaggcccctgtaacaatttg

SEQ ID NO: 2157 - DNA, 474 bp, Artificial
  Synthetic
ggggagacgtttgaattgggaataggaagagagcaaaaatggtggacttggcgagggtacaaaaggagctgcaagagtgcaacagagatgttggggtttcaggaataagtgtaacccttaaaggtgacagtctcactcacttgattggtacaatccctggtcctcttggtactccttatgaaggtggttctttcaagatcgatatcactcttactgatggctacccattcgagcctccaaaaatgagatttgccacaaaagtttggcatcccaatataagtagccaaagtggagcaatatgcctagacatcctgaaagaccagtctagcccagcgctgactctcaagacagctctcctttctatacaagcattactctttgctcctgaacctgatgatccacaagatgcagttgttgcacaacagtatctcagagaccatcagacctttgttggcacagctcgttactggactg

SEQ ID NO: 2158 - DNA, 250 bp, Artificial; identical to SEQ ID NO: 1988
  Synthetic

SEQ ID NO: 2159 - DNA, 625 bp, Artificial; identical to SEQ ID NO: 1065
  Synthetic

SEQ ID NO: 2160 - DNA, 692 bp, Artificial
  Synthetic
  misc_feature (413)..(413): The residue at this position can be any nucleotide.
acgcgtcggagaccaccccattctctctctctctctctctctctaccctgttttctcccgccctgtggttttaacacccctcgaaggctggtctttagcctgtgtgtgtgtgtgtgtgtctccctcctctcctttttctgttttgcagcgagttcgaattgaggagcagcaagttcgaattgcttagatggcgtccaagcggatcctgaaggagctcaaggatctgcagagggacccccccacctcttgcagcgctggacctgtagcagaggacatgttctactggcaggctacaataatgggccctgacgacagcccttatgctggaggtgtcttcctggtgaccattcatttccccccggattacccattcaaacccccaaaggttgcttttaggactaaaggttttccancccaaacgtcaacagcaatggaagtatctgcttggacatcttgaaagaacaatggagtcctgcattaaccatttcacaggttctgctctcaattcgctcattgttgaccgacccaaacccagatgaccccctagttccagaaattgctcacatgtataaagcggaacagggcgaaatatgaagccactgcaaggagctggactcaaaaatatgccatgggctaatgctaccccttatatatatataaggcgatgggtggtgagtctgtttccacatctt

SEQ ID NO: 2161 - DNA, 679 bp, Artificial; identical to SEQ ID NO: 1067
  Synthetic

SEQ ID NO: 2162 - DNA, 569 bp, Artificial
  Synthetic
actgtgtctgtctcccttccgtcgagatctgtggatcttatagcctagccctaaaggggaacagcaagctttggactttccatggcctccaaacggatcctgaaggagctcaaggatctgcagagggatcctcccacatcatgcagcgcaggacctgttggggaagatatgtttcactggcaggcaacaatcatgggaccgaatgatagtccatatgctggcggtgtgtttatggtgaccattcatttcccaccggattaccccttcaagccgccaaaggttgctttcaggactaaagtttttcaccctaacatcaacagcaatgggagcatttgcttggatatattaaaagagcaatggagtcctgctcttacaatatcgaaggtcctgctgtcaatttgttcgctcctgacggatccaaaccccgatgatccccttgttcctgagattgcgcatatgtacaagacagacagagccaaatatgaaggcactgcaaggagttggacgcagaagtatgcaatgggctgaatctctgacctctctcgcccctttgtaataatcaaaagata

SEQ ID NO: 2163 - DNA, 876 bp, Artificial; identical to SEQ ID NO: 1991
  Synthetic

SEQ ID NO: 2164 - DNA, 651 bp, Artificial
  Synthetic
gggcggacgcgtggggggcgattagggtatattggctttgtcgcggctatggcgtccaagagaatcctcaaggaattaaaggacttgcagaaggatccgcccacttcgtgtagcgcaggtcctgtggccgaggatatgtttcattggcaagcgacgataatgggtcctcccgatagcccctacgcagggggtgtgtttttggtcaccatccatttccccccggattatccctttaagccccccaaggtcgcatttagaacgaaagttttccacccaaacatcaacagcaatggcagcatctgcctcgacattctcaaggagcagtggagcccggccttgacaatctccaaggtgctgctatcaatctgctcgttgctaaccgatccaaaccccgacgatccactggtgcccgagattgctcacatgtacaagacagacaggcccaagtatgaatcgaccgccaggaactggacgcagaagtacgccatggggtaagcccgggcttgtgagcggcggcggcggcggtggcggtggcatggctcgctatgatgtttgtgataccatttggttgcctatctataagttgaaagcagggattgtctttgattatggaattcttttgattactgtatatagaatttctatcacgtc

SEQ ID NO: 2165 - DNA, 724 bp, Artificial
  Synthetic
gatcgcatgcacacggcagggaaggggaagtggaggaagggttgcgatctcgcggctggatcgtccaggatagggcgccgcatcgactcgccgcctacgccgccgctgccgccgccgccgctatggccgtgaccctgggtttgtagggattttccatccagatttcgaggagatcgctgcgcgtttctcgttcatggctgagaacttacccccaaaggtgattcgagcgcttgcaaaggagctcaagagcttggacgagagccctccagaggacattcgcgttcatgtaaatgacgacaacttctcgagcattttcgcggacattgagggaccacccggaacaccgtacgaaagtggcgtcttccggatcaggcttttgcttagtcccgatttcccgcaaacgccaccgaaaggttatttcgtcaccaagatcttccatccaaacatcgcaaagaatggagagatttgcgtgaacgttttgaagaaggattggaagccgacgctcggcctgaggcatgttcttcttgtcgtacggtgcttgctcatagagccgtttccagaatcggcacttaacgaggacgctggaaagatgttgatggaggattacgatggatacgcaaagcacgccagattgatgacaaacatccacgcgatgaagccaaagccaaagaccacgaaagtcgccatagccgagtcaacggtggtgaacagcaacgcggaggag

SEQ ID NO: 2166 - DNA, 705 bp, Artificial; identical to SEQ ID NO: 1993
  Synthetic

SEQ ID NO: 2167 - DNA, 668 bp, Artificial
  Synthetic
ggaaatatttgctacagggtagatgcttccccatttttaggtctaaagcttctttctcctccctcgattcgattcgatccatcggcggcggcggcgatgaacatgaacggcggcgtcgatgcgatcgcgcagcagcaagcgacgaacaatccggcgggtagcaagcagagcaaacccaatttgcagccggtggacagccattccgtcgcccggaggttgcagtcggagctcatggccttgatgacttgcggggacccgggaatctcagcgttcccagacggcgacaacatctttacgtggattggaaccatcaaagggagcgacgcgacggtgtacgaaggtctctccttcaagctctcgttgcgcttcccgaccgactatccattcaagccgccactggtcaagtttgagacgtcgtgtttccatcccaatgtcgatcagcatggcaacatttgcctcgacatcttgcaggataaatggtcctcggcctacgatgttagaaccgtgttgctgtccatccaaagcttgctaggagaaccaaacaacgatagtcctctcaacagctatgcggcagcattgtggccaaaccaagaagagtacaagaaagtgatgaacaggcagtgccgcgacggatctggtcgatgagaaagggtcgatcgacaagagag

SEQ ID NO: 2168 - DNA, 690 bp, Artificial; identical to SEQ ID NO: 2037
  Synthetic

SEQ ID NO: 2169 - DNA, 653 bp, Artificial; identical to SEQ ID NO: 1995
  Synthetic

SEQ ID NO: 2170 - DNA, 621 bp, Artificial
  Synthetic
gcgagagagagcaggaaggcgatcgatcagctcccggcggcgctgtcggaatccggatcttggagccgctgccatggccagtaccatcgccaacagcaatctcccgcggcggatcatcaaggaaacgcagcgattactgaccgagccagccgaaggcatcaaagcttcgcctgccgaagataatttgcgatacttcaatgtgatgatccttggccccgcacagtcaccctatgaaggtggtgcttttaaactggagctttttcttccggaagaatatccaatggctgctccaaagaactgcaataggttcgcttcttgacgaaaatttaccatccaaacatcgacaagctgggccggatttgcttagacattctaaaagacaaatggagtcctgctctccagattcgaacagtgcttttgagtattcaagctcttttgagtgctcccaatcctgaggatcccctggacgagaacatcgcgaagcactggaagacagaccaaggaggagccatcgcgactgcaagagagtggactcaactctacgcgacccataattaaatcaaaatgcggaccattcgtcatcttggttcgtttagttttttctgctttggtcatatttgt

SEQ ID NO: 2171 - DNA, 557 bp, Artificial; identical to SEQ ID NO: 1996
  Synthetic

SEQ ID NO: 2172 - DNA, 570 bp, Artificial; identical to SEQ ID NO: 1997
  Synthetic

SEQ ID NO: 2173 - DNA, 284 bp, Artificial
  Synthetic
atgaagatatattttcaagacctgcgataggttttgatatcaaaacggaagcttgctatggggtacgaacattattatgggaggagttgagagattattcttttcttccattttctttggcttggttgcaaatattttagaaggctcaaatttgtttcgagatgagccgcaagcgttactgtccgcgcttctatggtgtatgtcttagatagtacaagtggtcttgcagcagatataccactggcgcaatacatcatcacattacacacaaaaaaaaaaaccaa

SEQ ID NO: 2174 - DNA, 992 bp, Artificial
  Synthetic
acaggaccgccatcagggactctgcacccccgatcagataaagcctctacctagcgctcaggacttgcagacggtcgccttgcatcgtctccaacgtccgcctaggatcttttgattctttctttgcctcctcgatccgagatcgatcttccaccacccttttagataccacataccctcatcacaatggccctgaagcgcatcaacaaggagctcaaggacctcggcactgacccgccatcatcctgctccgctggtcctgttggagaagatctgtttcactggcaagctacaatcatgggacccggtgattcaccatactcaggaggcgtcttcttcctgaagatccagttccctacggattaccccttcaagcccccgaaagtcaacttctccaccagaatctaccaccccaacatcaacagcaacggcagcatctgcctcgatattcttcgagaccagtggagccctgctctgaccatttccaaagttctcctttccatctgctctatgctgacagacccgaaccccgatgatccccttgtgcctgagattgcgcacgtgtacaagaccgaccggccccggtacgaggcgactgctagggaatggacccgcaagtacgccgtctaggcaataccaaacggtttcttttaaggggttttgatggcgctgggtgtttgacgtcctctatcacgcaatgacggtgcggcatgtttggcgagcctctacgttataagcgggtgcggggatgatattcgaaggcggacagtgcaagttttttctttcttctccttgctgttctcatcatctcttcgggtgcaccgcatttatgatgctgggggtgagacgacgcatggccggcggacaggtggcagactagacagaaatatccgctattcaagggcttatgcggctggacttgactttgggtttgcatcaacaacgtgtactctgcatccaacaacaggcatctgatttaacgcgtctatacg

SEQ ID NO: 2175 - DNA, 764 bp, Artificial
  Synthetic
gcttttatcacttttgagaaccactcattcatccatctccgcaagatcgtctgtttttgtttacaatggattataccgaggataaccagaattctgctcctggcagcgtccaggcttccaagctcaatgccgctcgcaagggtcccgattcgcagagcgtcactaaacgactccagaccgagctgatgactctcatgacatctccagcacccggtatctccgcattcccctctgccgacggcaaccttatgtcgtggaccgccaccatcgagggccccgaggatacaccttattccggactcacgttcaagctgagcttcgcgtttccttcaaactatccttatgccgcgccgacggtcctcttcaagacgcccatctaccaccccaacgtcgacttctctggccgcatctgccttgacattctcaaggacaagtggacagccgcctacaacattcagaccgttctgctgagtctgcagagcttactcggcgagcccaataacgcatctccattaaacggcgaggcagcagagttgtgggacaaggatatggaagagttcaagaagaaggtgttgggacgccatcgcgacatcgaggaggagtaatgggattcatagcgtgcagatttttatgattttacgtttacgggtatttggagtctttggggcacgaatcggtcgtttttgaaagggtatttgggtgtattttgcatttccacagccagagctgggaaaggagggctacctgccccttccacaagcgca

SEQ ID NO: 2176 - DNA, 752 bp, Artificial; identical to SEQ ID NO: 2038
  Synthetic

SEQ ID NO: 2177 - DNA, 616 bp, Artificial; identical to SEQ ID NO: 2043
  Synthetic

SEQ ID NO: 2178 - DNA, 573 bp, Artificial
  Synthetic
ctcacctggcgcgccgaagcttctctcctctctctcaactccggcgagaggaggaggcggcggtggggcgttcgtcgggagagagaccagggccggggggctagggttcggccgttcagagaggcggcggctgaggaggaggaggaggaggaggagggggtgaggagagatgtcgacgccggcgaggaagcggctgatgcgggacttcaagcggctgcagcaggacccgcccgccggaatcagcggcgcgccgcacgacaacaacatcatgctctggaacgccgtcatattcggaccggatgacacgccgtgggatggaggcacgttcaagctgacactacaatttacagaagattatcccaacaaaccaccagttgttcggtttgtctcaaggatgtttcacccaaatatttatgcagatggaagtatctgcttggatatcctacaaaatcaatggagccctatatatgatgttgctgcgatattgacctctatccagtccctgctctgtgatccaaacccaaactcccctgcaaactccgaagcagccagactgttcagcgagaacaagcg

SEQ ID NO: 2179 - DNA, 666 bp, Artificial
  Synthetic
cccaactccattattgattcttgcaaggaggaagagcagctagaggcgaggcaagaaaagaagtgaaatctctccgttagacaggaagaggaaaagcaagggggaattggggatggcgtcaaagaggatacagaaggagctcaaggatctgcagaaggatccccctacatcatgcagtgcaggtcctgttggtgaagacatgttccactggcaggcaacgataatgggtccatctgatagcccatatgctggtggagttttcctagttaccatccacttccctcctgattatcccttcaaaccacccaaggtggcgtttcgcaccaaggttttccatccaaacatcaacagcaacgggagcatttgccttgacatccttaaggaccaatggagcccagcactaaccatttccaaggtgttgctgtcaatctgttccctgctgactgatccgaaccctgatgatcctctggtccctgagatcgcccacatgtacaagacagataggcacaagtacgagaacacagcaaggacctggactcagaggtacgccatgtagcacctcagatatcgatggacatgtcgatgttgtaacaacattatcaacgggtgtgtctccctctcgccttgtgtggtgtaaggatcaaaaccggctttgcagtgcactct

SEQ ID NO: 2180 - DNA, 552 bp, Artificial; identical to SEQ ID NO: 1077
  Synthetic

SEQ ID NO: 2181 - DNA, 707 bp, Artificial; identical to SEQ ID NO: 1978
  Synthetic

SEQ ID NO: 2182 - DNA, 641 bp, Artificial
  Synthetic
tcgacccacgcgtccgaacaatccccagcctcaccaaaaaggacacaaaataacgacattcactctctctctctctctctcttcctcttttctccattctctcgcggggtcatccgcccaccatggcccaatccaccgcccaccgccgcctccttcaagaataccgcgccctcacaaacaacccgcccgaaggcatcaccgccggccccgtctccgaggacgacctgctgcactgggaatgcctcatccaggggcctgagggaactccctttgagggcggcgtctttcccgcagagctcaagtttcccaaggactatccgctggcgccgccgacgatgaagtttctcgctgacatgtggcatccgaacgtctaccccagcggcctcgtctgcatctccatcctccaccctcccggcgacgaccccaaccactacgagcacgcctccgagcgctggtcccccatccagtccgtcgaaaagatcctcatctctgttatgagcatgctagctgagcccaacgacgagagccccgccaacgtcgaggccgccaagatgtggcgcgagcgtcgggatgagtacgaaaagacggtccgcgacggtgttcggcgcatgttgggtttgtaacagcgcatgttgggtttg

SEQ ID NO: 2183 - DNA, 599 bp, Artificial; identical to SEQ ID NO: 1979
  Synthetic

SEQ ID NO: 2184 - DNA, 483 bp, Artificial
  Synthetic
gtcctcgtcctcgcgtaggcgcggcggccgaggaacaagtccgtcacgcgaaccttccagaaccccctcctcacacgtcacgcaacctcctcctcctcctcctcctcctctttattacgactacccccccccccccggcgccccctccttttttcagattcggagagacctactcgtcgttagaccgccatggcgtccaagcggatcctcaaggagctcaaggacctgcagaaggatcccccaacctcctgcagcgccggccctgtggctgaagatatgttccactggcaggcaacactgatgggtccatcagatagcccttatgctggaggcgtgtttttggttaccattcattttcctccagattatccattcaaaccgcctaagggggcattcaagacaaaggtgttccacccaaacattaatagcaacggaagcatatgccttgatatcttgaaggagcagtggagtcctgcattgact

SEQ ID NO: 2185 - DNA, 614 bp, Artificial
  Synthetic
ctctctaggaaggcggaatactccttctcttctcttctctctctcataccgaggtattagggttccacaggcggagagaagagagagagagagagagcgtctttcttcctctaccgctgctactactactgctacgaccatgtcggggatcgccaatgctaacctaccgcggcggatcatcaaggaaactcaacggttattgagcgagccagcccctggcataagtgcatcaccttctgaggataacttacggtatttcaatgttatgattcttggcccaactcaatctccctatgaaggcggggttttcaaattggaattgtttctacccgaagaatacccaatggcggctccaaaggtccgattcctgacaaaaatttatcatccgaatattgacaagctggggcgcatctgcctcgacattttgaaagacaagtggagccctgcactccaaattcggacagtccttctaagtattcaggcccttttgagtgcaccgaatcctgacgatccactttctgagaacattgcgaagcattggaagactaacgaggcagaagctatgcaaacagcaaaggagtggaccaggatgtatgcctgtggggcctgaaaac

SEQ ID NO: 2186 - DNA, 656 bp, Artificial
  Synthetic
gcacgaaactcaaagcatccccggcgccgcagctccccggaggaggaagcccccgcgccccgccccgaccagatccgatggccaacagcaacctcccccggcgaatcatcaaggagacgcagcgactcctcagcgagccagcgccgggaatcagcgcgtctccgtcggaggagaacatgcgctacttcaacgtcatgatccttggcccggcacagtccccctatgaaggtggagtttttaagcttgaactctttttacccgaggaatatcctatggctgctccaaaggttaggttcctgaccaaaatataccaccccaacattgacaagcttggtaggatatgccttgacattctcaaggacaaatggagcccagcccttcagattcggacagttcttttgagtatccaggcactcctaagtgcaccaaaccctgatgatcctctctctgataacattgcaaagcactggaaagccaatgaagcagaagctgttgaaacagcaaaggagtggactcgcctgtatgccagcggtgcataaaacccaatgcctctcgtgatgtaataacccgtcatgctttagccttaatcaaatgccatttgcttgataagaacaaactggagatattggcagtggaagggagtttaaatgactacc

SEQ ID NO: 2187 - DNA, 712 bp, Artificial; identical to SEQ ID NO: 2008
  Synthetic

SEQ ID NO: 2188 - DNA, 529 bp, Artificial
  Synthetic
ggccttataaccttagttacctatagtccattgacggttcgcaatcagaatggctacttctgcgcagctccgcctcatgtcggacctcaaagccatcctcagcgagcctcccgaggtgggattttttctcttcgtttgatattcggagatcaatatcctgaaaagccacctcgtgttagatttactagcgagattttccatccaaatgtgtacaacgatggaaccttatgcatggatataattcaggatgcttggtctccctgccacaacatctgcactatattgacttcaatacagtctttattgacggatccaaatccagagagccctgctaacccagaagctgcacacttatatcggaccgatattcaagcatataataggaggatcaagcagtgcgtaagaaagtctttggatagttaatgagtatggaatttcgactgaaagtaaacatgacgtaatttggctcttgctaggcattcacaggtctaaactaaactatggttaaagaagattgaataactcacta

SEQ ID NO: 2189 - DNA, 605 bp, Artificial
  Synthetic
gagaagaactgtggtgggtggggggccataataataagaagaggtattattattattattattattattagtattataatgagcttgcagagaggagggcaggagggtagcttggctatggcggatggaaagcactctggtgcccccgttgatacacattccgtcgctcgtagattgcagtcggagctcatggcattgatgacctgtgggggggacccaggtgtatctgcttttcctgacggagacaacatcttctcttggcttggaaccatcaaaggaagcaccgcaactgtctatgagggtctctcgttcaagctttctttgcgctttccaaatgagtaccctttcaagcctcccactgtgaaattcgataccccttgcttccaccccaacgttgatcagtatggcaacatttgccttgacatcttgcaggataagtggtcatctgcttatgacgtccgcaccattctcttgtctattcaaagtctacttggagagcccaataatgctagtccattgaacagttatgcggcaactctatggtgcaatcaagaagagttcaagaaggcgatgcaaaaacatcacaaagatgctactggacttac

SEQ ID NO: 2190 - DNA, 361 bp, Artificial; identical to SEQ ID NO: 1971
  Synthetic
  misc_feature (234)..(234): The residue at this position can be any nucleotide.

SEQ ID NO: 2191 - DNA, 663 bp, Artificial
  Synthetic
tataacggcggtggctatttaagaactccaagtagcagaagttatagttgaagagggatctggatctgaatctgaatctgtgtcatggctagcaagaggattttaaaggaactcaaggatctgcaaagggatcccccaacctcatgtagtgctggtcctattgcaaatgatatgttccattggcaagccactatcatgggtccctttgatagtccatatgctggaggagtttttctggttaccattcatttccccccagactacccatttaagcctcctaaggtgtccttcaaaaccaaagtcttccatccaaatgtcaatagtaatggaagcatttgccttgacatcttgaaggaacaatggagtcctgctctaacaatagcaaaggtcctactctcgatatgctctcttttgactgatcccaatcctgatgaccctctcgttccagaaatagcccacatgtataaaacagacagggcaaagtacgagacaactgcaaggagttggaccttgaagtatgctatgccctaaataaagctcacctcttgccttgcatatagttgaggtatatatattatatatatacacacacgttattacatatgcaactactattgcattgctataatctttgctagaatctccaataagatatgtaatatg

SEQ ID NO: 2192 - DNA, 577 bp, Artificial
  Synthetic
agaaaaggattgagatcggcaaaagacagaaggatttcgcattcctgggtttgttgtgtgaccgaaactggatggataagcctctttaaccccaacaagggcagcgtttaatcactttcaacaagtccggggggttggttgcatacaatccaacataagctttcactttcttccaaaggcgatcaatctcttgccacaatgtccacgccgtcaaggaagcgtttgatgcgtgatttcaagcggcttcaacatgacccccctgctggtattagtggtgctccgcaggacaacaatatcatgctttggaatgctgtcatatttgggccggacgacacaccttgggatggaggcactttcaaattgaccttgcaattctcggaagactaccccaataaacctccaacagttcgttttgtgtcaaggatgttccatccaaacatctatgcagatggaagtatctgcttggacattctgcaaaatcaatggagccccatatatgacgttgcagcgatacttacatctattcagtctttgctttgcgatccgaacccgaattctcctgcgaattcggaggcag

SEQ ID NO: 2193 - DNA, 609 bp, Artificial
  Synthetic
ttcccatctctctctttctctctctctaggtatggcgtcgaaacggatacagaaggagctgcaggacctgcagaaggaccccccgacgtcatgcagtgccgggccggctggggaggacctcttccactggcaggccaccatcatgggcccctctgatagcccctacgacggcggcgtcttcttcatcaccattcacttcccccctgactaccccttcaagccccccaaagtcagcttccagaccaaggtttatcatccaaacatcagctcgaacgggagcatttgcttagacattctaaaggaacaatggagtccagcgttgacgatttcaaaggtgttgttatccatctgctctctgcttacggatccaaatccagatgaccctcttgtccctgagatcgctcacatctacaaaacccagaaggctcgctacgaggagaccgcccgagcatggacccagaaatatgcaatgaactagttgaaaaatttccttacatatccttgcccacccttcaaactataataagcataaggtatgctttctatatatggaggctaatcgttattgtttctccgttgtctttctctatcatcaatcacagtttcttg

SEQ ID NO: 2194 - DNA, 761 bp, Artificial
  Synthetic
tgtttttagtgagacaaagagtgtgaaactctcttacaatttctactttctctctctagaaaaaaagagacccttagcgtaaattttctgcgatcaaaaaaagaattcgattcaattcaatggccaacagcaatcttcctcgaagaattattaaggaaactcaacgtcttctcagtgaacccgcgccgggaataagtgcgtctccttcggaagaaaatatgcgatacttcaatgtcatgattcttggtccaacacaatctccttatgaaggaggtgttttcaaactggaactctttttgcctgaagagtacccaatggctgctccgaaggttcgatttctcaccaaaatataccatcccaacattgataagcttggtaggatatgccttgatattctcaaggacaagtggagtcctgctcttcagattcgcaccgttcttttgagcattcaagcacttctgagtgcaccaaatccagatgatccactctcagagaacattgcgaagcattggaagtcgaatgaggctgaagctgttgaaacggctaaagaatggacacgcctgtatgcaaccggtgcctgaaacggcatgactaagtgattttgaaaagaaaaagaaaaaagatgtggaatgtaatttatccactgtctaatcaggggacatgggaggactgaaagctaaattaccatctataatattttccctacccttgaaattgtatagtcaaatattgcacctttttattccaagttgaagaaactt

SEQ ID NO: 2195 - DNA, 783 bp, Artificial; identical to SEQ ID NO: 2036
  Synthetic

SEQ ID NO: 2196 - DNA, 713 bp, Artificial; identical to SEQ ID NO: 1981
  Synthetic

SEQ ID NO: 2197 - DNA, 612 bp, Artificial
  Synthetic
gaacggctgcgcgtcttcccgttcgtcctcctgtccggtccgagcccctctgacgacgcgactttccccacgccgggatcgagctccggggaggggagctgcgagctgaaacactttgtcatatcagtcaacagtagagaggagaccagatgcaggcatctagagctaggctctttaaggagtataaggaggtgcagcgagaaaagtcagctgatccagatatccagttaatctgcgatgattcaaacatattcaagtggactgctcttatcaagggcccttcggagacaccttttgaaggtggtgtatttcaacttgcattctctattcctgagcaataccctctccttcctccgcaagttcgcttcttgaccaaaattttccacccgaatgtgcatttcaagacaggtgagatttgcctggatatcttgaagaatgcgtggagcccagcatggacactacaatccgtttgtagagccataattgcattgatggcccatcctgaaccagacagtccacttaactgtgactcaggcaacctcctgcgctcaggcgacatcagaggctatcaatccatggcaagaatgtatactaggttggctgccatgccaa

SEQ ID NO: 2198 - DNA, 666 bp, Artificial
  Synthetic
gccattacggccgggaatcaaaatctatctcaacccttctgtcttcttcttccccttcagtttctcaaaaattctcaagaagaagaagaaagaaagaaaaaaatcgtctccttttctgttcaaaaaaaatatatcttgaaattaaaaattcagatggctacaatgaacagtggaaacaacagcaatactcaagcaactgctcaggttatgccttcacctaaacagagtttgcctactgcaaaaactgttgatacccagtctgttcttaaaaggttgcagtctgaattgatggctctaatgatgagcggtgattctgggatatctgcatttcctgaagaagacaacatatttgtttggaaagggacaataactggtagcaaagatactgtttttgaaggaacagaatacaagctctctctttcatttcctgctgattaccctttcaaaccaccaaaggttaaatttgagactggttgctttcatcccaatgttgatgtctatggcaacatatgcttagacattcttcaggataagtggtcatctgcttatgatgtgaggactatactgatttccattcagagtctgcttggagagccaaacataagctcacctctaaacactcaagctgctgctctttggtgcaatcaagaagaatacagaaagatg

SEQ ID NO: 2199 - DNA, 711 bp, Artificial; identical to SEQ ID NO: 1082
  Synthetic

SEQ ID NO: 2200 - DNA, 664 bp, Artificial
  Synthetic
agaaatcaaatcgaccccttactcctctaaatccccacacccatctctctctctctctctctcctcaatcgaaggatccgacaataaaagttgattgtcttcaacatctgtctaccagcaaaaactacttgcgtgcagtcgccaactgatcctaggattatacttacatttggctatggcaactaatgaaaatctcccaccaaacgtgataaaacaattggcaaaggaattgaaaaatcttgatgaaactcctcctgaaggcatcaaagtaggtgtcaacgatgatgatttttcaaccatatatgctgatatcgaggggccagctgggactccttacgagaatggggttttccgcatgaagttgattttgacgcatgatttccctcattccccacccaaaggttattttctgaccaagatttttcatcccaacatcgcttccattggcgaaatttgtgtcaatgctctgaaaaaagattggaatcctagtttgggcctacgacatgttctcatggtggtaaggtgtttgctgatcgagccatttccagaatctgcgttaaatgagcaagctggtaaaatgctgcttgataattatgatgagtatgctagacatgcaaggctttataccagtattcatgctaaaccaaagactaagttaaaaaca

SEQ ID NO: 2201 - DNA, 584 bp, Artificial; identical to SEQ ID NO: 1057
  Synthetic

SEQ ID NO: 2202 - DNA, 636 bp, Artificial; identical to SEQ ID NO: 2002
  Synthetic

SEQ ID NO: 2203 - DNA, 619 bp, Artificial
  Synthetic
atggcttccaaaaggattcagaaggagctgaaagacttgcagaaggacccccccacatcatgcagtgcaggtcctgttgcggaagatatgtttcactggcaggcaacaattatgggaccagatgacagtccttatagtggtggtgtgtttttggtgacgattcatttccccccagattatcccttcaagccccccaaggttgcttttaggaccaaggttttccacccaaacatcaacagcaatgggagcatttgcctggatatattaaaagagcaatggagtccagctctgacaatatctaaggtcttgctttcaatctgctcacttctcactgatccaaaccccgatgatcctctggtacctgagattgcacacatgtacaagatagacagagcaaaatatgaaggtattgcaaggagttggacacagaagtatgcaatgggttgagccttttttttcggcaaaagataacaacttttatcagtctatctcatatctaaaaagaatcggtttacaactttctgtttctgcatcttgttggtccaaagctcaaatcacacgtgtatctttactttcatagccaaggagttgatatagaagtagtgcaaggaacaggtac

SEQ ID NO: 2204 - DNA, 707 bp, Artificial
  Synthetic
  misc_feature (190)..(190): The residue at this position can be any nucleotide.
tccgctcactcacttactcactcactgcttacagatttagggattccagaaagcaagctgtgcgagcggtccttcatggctctgctgatctagttgaagattacctgacctgacttcgttcctccatggcaacaaatgaaaatttaccacctaaagtcataagggagctggctcgggagctaaaggcatnggatgagagccctccggcggatatcagagtgctagttaatgaggacaatttgtccatcatatatgcagatattgaaggaccatctggcacaccatatgagggaggcgtcttccgcttgaagttggtcttaagtcaagattttccgaatacacctcccaagggatatttcatcacaaagatttttcatccaaatgtagccaacaatggggaaatatgtgtgaatgtcctaaaaaaggattggaagcctgtgttggggttgcgacacattcttttggtaatcagatgtttactcatcgagccattccctgaatctgccttgaatgaggaagcggggaaaatgcttatggaagattatgagggctatgcgaaacatgccaggctaatgacgagtatccatgcaaacaaattgagggcaaagactagcaatagcatgaatgcgggtggtccaggtccaactgaactggtaagctctatgactactaacaatagcattttaactccaagctcagatgcgggt

SEQ ID NO: 2205 - DNA, 546 bp, Artificial
  Synthetic
cggtagtagtagtggaggaagaacatggccgtcgacgacgtcggtgtctagttccggtaagagaatacagaaggaaatggctgaactaagcatagaggcgccaccagattgtgcagctgggcctaaaggcgataatctttaccattgggttgccaccctcttcggcccacctggaacaccttatgagggtggaatatattttgtcgatataaccttcccttctgattatccatttaaacctccaaaggttgtattcaaaactcgcatatatcattgcaatgtcgagccttctggaaatgttagcttggacatcctaacagataactggagtccagcattaacaatctcgaaagtactacttgctctgagatcaatgttcaccactccagaaacctataagccagttgttcctggtattgcacacttatactttgaagataaagccaaacatgatgaaatagctacacaatggacactgcgatttgcaaggtgaaaaaaatgaattcaatgtggaattttcttaaccaagttctggtcagccccctg

SEQ ID NO: 2206 - DNA, 556 bp, Artificial
  Synthetic
cccacgcgtccgttcagtttggggtgagtttgaggggtcagtagtagtagcagtagcaggggaaaggggaagggagagcggtatggcttccaagcggatcctgaaggagctcaaggacctccagaaggacccccccacctcttgcagcgcaggtcctgtagccgaggatatgttttattggcaagcaacaataatgggtccacctgatagtccatattctgggggggtgtttttggtcaccattcatttccctcctgattatcccttcaagcctccaaaggttgctttcaaaactaaagtcttccacccgaatgtcaatagcaatgggagtatctgcttggatatactgaaggaacagtggagtccggctcttaccatctccaaggttcttctgtcaatatcctctttgcttaccgaccccaatccagacgatcccctcgttccggagattgcacacatgtacaaaacggacaggatgaagtatgaaacaactgcaagaaattggaccaggaagtatgccatgggataaaagacaggatctcgtttcttctcatac

SEQ ID NO: 2207 - DNA, 548 bp, Artificial
  Synthetic
tctgtttttctgtgaatccctcgcagagagtatctccactactagcgcgccagagattttctgccatcctgtcgttgcgggaattgttattataaagaaaatgagcttgaacagagcctcaggcgtggtgatgaacggggtgatgggtgaccctgctgcccctgtccctgctgcagctgctggaaagcagtctgcccctgcctcccatcccgtcgaaactcactccgtctctcgcagattgcagtcggagctcatggcattaatgacaagcggagacccaggcgtgtcggccttcccggacggagacaatattttctcatggatgggaaccatcaaggggggaaccggaactgtctacgagggaatgtctttcaagctctctttacgcttccccaacgagtacccattcaagcctcccactgtgaagttcgacggtgcatgcttccacccgaatgtcgaccagtttggcaacatctggctcgacatcctccaagacaagtggtcatctgcttacgatgtgcgtacagtccttctctccattcaaagtc

SEQ ID NO: 2208 - DNA, 689 bp, Artificial
  Synthetic
gagcgcatctcaaaagccccaagcctagggcctgtcttccccttggaacaaaagcaccccccacccatagccattagccattagccattatgtcagaaactcaggctagccttctccttggcaaacaacttagagagcttttaaaatctccagtggaaggtttctcagcagggctggtggatgattctaacctctttgaatggaatgtgaccattattggtcctcctgatacattatatgaaggtggtttcttcaatgccattatgagctttcccaaaaattatccaaatagtcctccaacagtcaggttcacctctgagatgtggcacccaaatgtgtatccggatggccgtgtttgtatttccattcttcatgccccgggggatgatccaaatggatacgaacatgctagcgagcggtggtcaccagtgcacacggtggaaaccattctattgagcatcattgcaatgctttccagtccgaacgacgagtctccggcaaatatagatgcagcaaaggaatggagagagaacagggcggagtttaagaagaaagtgcgtcgcattgtacggcgatctcaagagtgtctctgaatttggcaatataccagggtatgtatcctcattgagaaacccttgaaacttctctgaattgatagaaaaaaggaagggacatacatatatatcaga

SEQ ID NO: 2209 - DNA, 665 bp, Artificial
  Synthetic
tgcttacaggcgttagaagagaagacggagagagagagagagaagggaagtccaggcgtctctatctttcttactctgcccttctcagcattcccactgccatgtccacccctgcacggaagcgcttgatgcgcgacttcaagcggcttcaccatgatccccctgctggcataagtggtgctcctcaggacaacaacattatgctttggaatgctgtcatctttgggccggatgacacaccatgggatggaggtacgttcaagctgacattacaattttctgaggactatccaaataagcctccgacggtccgttttgtgtcgaggatgttccacccaaacatttatgccgatggaagtatctgcctggatattctgcagaaccaatggagcccaatctatgatgtcgcagcaatacttacatccattcagtctttgctctgcgatccaaacccgaactctccggcaaattccgaagcagcacgaatgtatagcgaaaaccggcgagactacaaccggaaagtgcgcgaaatagtggagcaaagctggacggctgaatgatggatgaactgtctacctctagtgatatacaagtgtgtcgaaacagttgcatgaggttgaactaattctctccttttacaagtttggcactttcgtaaaaattct

SEQ ID NO: 2210 - DNA, 716 bp, Artificial
  Synthetic
cccacgcgtccggtcgttgcttaattactgttcattcacaggaggatcctaatctctttcaggagtcgctatggcttcaaagcggatcttgaaggagctcaaagatcttcaaaaggatcctcctacttcgtgtagtgctggacctgttgctgaggacatgtttcattggcaagcaacgataatgggtcctccagatagtcctttttctggtggtgtttttctggtgacgattcattttcctccagattatccattcaagccacctaaggttgctttcaggacaaaagttttccacccaaacataaacagcaatgggagcatatgccttgacattttaaaggaacagtggagccctgccctaacgatttccaaggtgttgctttcaatatgttctcttttgacggacgccaatcctgatgatcctttggtcccagagattgcacacatgtacaagacagacaggaacaagtatgagacaactgcaaggagctggacccagaagtatgccatgggctaaacgtacctttgtatcatggggtcaagggcattttactttcagatacttcactatttacattcaatgtactaatctgttctttgagttgtaacatggagtccatgtcttaagaggaaaggaaaatcatggacgctgctcctaaaagtttgtatgtgcaaattgatctttgaaagaaaccaattaattagacttttctttc

SEQ ID NO: 2211 - DNA, 696 bp, Artificial; identical to SEQ ID NO: 1131
  Synthetic

SEQ ID NO: 2212 - DNA, 487 bp, Artificial; identical to SEQ ID NO: 1132
  Synthetic

SEQ ID NO: 2213 - DNA, 956 bp, Artificial
  Synthetic
tggtatcaacgcagagtgccattacgccggggactcacaacagaaatagctactaaacaaacagcaaaagataaccagaaaagatggcgactttccctgttgttgatttggggttgcttcaaactgggaaaagggctgaaacattggataaaatcaaagatgcatgtgaaaactggggtttctttgagcttgtgaatcatgggatttcccatgaagtgttggacacagttgagaagcttactaaggagcattacaagaaatgcatggagcaaaggttcaaggaaatggtggaaagtaaaggtcttgaggctgtccaaactgagattgatgatctggattgggaaagcactttttacttgaaacacctccctgtttccactgtgtatgaagttccagacttagaggataaatacagaaatgttatgaaagacttcgcgttgagtctagagaaactagctgaagatcttcttgatttgctgtgtgaaaatctcgggctcgagcaaggttatttgaagaaagcattttatggttcaaagggtccaacttttggtaccaaagttagcaactatcctccttgccccaaaccagaactgatcaaaggcctacgtgctcacactgatgctggtggcctaatcctgcttttccaagatgacaaagtcagtggtcttcagttactgaaagacggtaattggattgatgtcccacctatgaaacactcgattgttatcaaccttggcgaccagctggaggtcataacaaatggaaagtacaagagtattgagcacagagttattgcacaacaagatggcactagaatgtcaattgcttcattttataatccaggaagtgatgctgtgatatttccagcaccagaattggttgaaaaggcagaagaagagaacaagttgaagtatcccaaatttgtgtttgaagattacatgaagctgtatgcaggt

SEQ ID NO: 2214 - DNA, 646 bp, Artificial
  Synthetic
gtatattgccgaggagggcgctgtcagagattggagggactacctttacctccaccttgaccctccctccactagagattataaccattggcctgtggatgcaagttttagggagaccgttgacaaatatagcaaggagaccctaaaggttgggaaaaagttgttaagcctcttatctgaaaatttgggtcttcatccatcttgttttgaggagcatctagtaaaaattcaccaaaagatgctcattaactactaccctccatgcccagagcctgagttgaccgcaggatttcacaaacattccgattttggagccataacattagtgatgcaagaagttggtgtagttggcttgcaagtccacaaagatggagagtggattccaatcatcccagaaaaaggtgcttatgtggtgaatattgcagatcaagtggagattttaagcaatggacgatacaagagtatagagcatcgtgtagtcacaaatccctacaagtctcgaatatctgtacctgttttccatgatgcagctcttgatgctgttatttctcctattaacaatatcttgaaaaatgaaaatgattgccaatacaagaaatgcagatttgaggaccatgagataacattctattcctatggagcaaat

SEQ ID NO: 2215 - DNA, 635 bp, Artificial
  Synthetic
aattgttggagatcctctgcaaagaactgggattggacgaaaactacataactcaacacttggacaatggaagcaactcggtgtttcgcttcaatttctaccccccttgcccaaagccttccatgatgatgggattgggagcccattctgaccctcacattctgacaatcctacatcaagatcaaattggcgggctccaggtctttaaagactctaaatggatcggggtgcgacctcaggccaactcgttaatcattaatgttggcgacgctctccaagtgtggagcaacggaatctacaagagcatcgaacatcgagtcgtgtgtaacaatatgagtggccggttgtctatggctttttttctcaatccaggggaggacacacagataacacctgccccgaaactatttaacagtgactatgagcactgtagcaaatacaagagctttacatggaaagaatatcgccaatccatgtacgcttacagactgaaggggaaaagcaacctccaacgcttcaccctccattagcattattaataggctaaaaaaatgcaaggctcttctaccttgcttgggaaactctcaatgtccttagttggcattagaaaatttgatgtagttacaaaataaact

SEQ ID NO: 2216 - DNA, 251 bp, Artificial; identical to SEQ ID NO: 2067
  Synthetic

SEQ ID NO: 2217 - DNA, 655 bp, Artificial; identical to SEQ ID NO: 1156
  Synthetic

SEQ ID NO: 2218 - DNA, 676 bp, Artificial; identical to SEQ ID NO: 1154
  Synthetic

SEQ ID NO: 2219 - DNA, 681 bp, Artificial; identical to SEQ ID NO: 2060
  Synthetic

SEQ ID NO: 2220 - DNA, 883 bp, Artificial
  Synthetic
gcgtccggaacaatgccgactcagggagtgaaggagctagtggagaattctcaagatcatataccagataagtatatcaagcccgagcgtgcccgtgttagatacaacagttccacagcagggattcccctcattgacctcgctgaaatccatggacaaggaagaagtgatgttcttcgtgccataagagatgcggcaggagagtggggattcttccaggtgatcaatcacagcgttccaccagctttgatggaggctatgatgaaggctgctcgtgagttcttcgacctgcctctagaggaaaaaatggcatatttttctgaagattttgaggagagaattcgtttctgcaccagctttgttccttcaacggaagaacgctgggactggcaagacaacctctcgcatacttttccaccttacggagacgatcacccctggccaaagaagccacacttgtacgaggaagttgcgaaggagtatctccaccaggttttggagctggggaacgcaatcgcaggtgcaatctctgaaagcttgggcttagaaaaagactttctcctaaaggcgttcggagagggcaggcacaacatgcgtctaaactattatgcaccttgtccaagacccgatcttgcagtgggcttcagtcctcactccgacttcggaggttttaccatcctgatgcaagaccaagtaggagggcttcaggtgaaaaaggacgaggactggtactttgtcaaaccagtcaagcactccttcgtggtcaatatcagtgatcaactcgagatatttagcaacggtaggctccggagtgccgaacaccgagctacggtgaactcaagctccgaaaggatttcaattggctacttgctttgagccttct

SEQ ID NO: 2221 - DNA, 507 bp, Artificial; identical to SEQ ID NO: 2061
  Synthetic

SEQ ID NO: 2222 - DNA, 575 bp, Artificial; identical to SEQ ID NO: 2063
  Synthetic

SEQ ID NO: 2223 - DNA, 642 bp, Artificial; identical to SEQ ID NO: 2065
  Synthetic

SEQ ID NO: 2224 - DNA, 681 bp, Artificial; identical to SEQ ID NO: 1152
  Synthetic

SEQ ID NO: 2225 - DNA, 1191 bp, Artificial
  Synthetic
aaaatacatagaaagatggagagtttcccagtggttaacatggagttgcttaacactgaacaaagggctgcaacaatggagaaaattaaggatgcttgtgagaactggggcttctttgaggtggtaaatcatgggatctgtcatgagcttctggacacagtggagaagttgacaaagggacactacaagaagtgtatggaacaaaggtttaaggaaatggttgcaagtaaagggcttgaagctgttgagactgaaataaaggatttggattgggaaagtactttcttcttgaaacaccttcctgtttcaaatatctcagaagttcctgatcttgaagatgaatacaggaatgtagggaaaatcatgaaggagtttgctgaaaagctagagaaattagctgagcaacttttggacttgctctgtgaaaatctaggactggagcaaggttacctgaagaaagccttttatggttcaaatggtcctacttttggcaccaaagttagcaactatccaccatgtcccaagcctgatttgattaaaggccttagggctcacactgatgctggtggaatcatccttctattccaagatgacaaagtcagtggtctccaactactcaaagacgacaaatggatcgacgttccaccaatgcgccactccatcgtcattaacctcggagaccaactcgaggtgattactaatggaaagtacaagagtgtggagcatagggtgattgctcagcctgatggaaacagaatgtccctagcttcattctataacccggggagtgatgctgtcatctatccagcaccagaattgttggagaaagagaacaaagtcatttatcctaagtttgtatttgaggactatatgaaattatatgcaggtcttaagttccaggctaaagagccaaggtttgaagcaatgaaggctgtggaaactactgtcaactctgccccaatagctactgtttgagactttgatggagtattaattagaaaactgattaatgagaagaaaatggcttagtattaagattatgatgatgtattgatgatttgtttatattgattagttggggtgttttccttgttttatgccacttgggtttttcatgtactgttgtctggtagtctaagaggaatttattgttatgttctcaaaagaagttccttttaacttgaaaaaaag

SEQ ID NO: 2226 - DNA, 688 bp, Artificial
  Synthetic
aagaaagccttttatggttcaaagggtcctacttttggcaccaaagttagcaactatccaccatgtcccaagcctgatttgattaaaggcctcagggctcacaccgatgctggtggaatcatccttctattccaagatgacaaagtcagtggcctccaactgctcaaagacgacaaatggatcgacgttccaccaatgcgccactccattgtcatcaaactcggtgaccaacttgaggtgattactaatggaaagtacaagagtgtggagcatagggtgattgctcagcctgatggaaacagaatgtccctagcttcgttctataacccggggagtgatgctgtcatctatccagcaccagaattgttggagaaagagaacaaagtcatttatcctaagtttgtttttgaggactatatgaaattatatgcaggtcttaaattccaggctaaggagccaaggttcgaggcaatgaaggctgtggaaaatactgtcaacgctgccccaatagctactgtttgagacttttcatggagtattaattagaaaactgattaatgagaataaaatggcatagtattaagattatgatgatgtaataatgatttgtttatgttgattagtggggggtgtttttcttgttttgtgccactttgggttttttcatgtactgttttctggtagtcta

SEQ ID NO: 2227 - DNA, 654 bp, Artificial
  Synthetic
gaaatcatactagaggctatgtcaataacacttgggctcaacccaggaacgttaaaagaagcatttggaggcgataaaaattgcagcttaagtcaacgtattaatttctacccttcttgccctcaacctgacctcaccttagggttatctcctcactcggaccccgggggtctaactgtccttcttcaagatgaccaagtcagtggcttgcaagtgcactacgagggggaatgggttgatgtcaaacccattcctggtgcatttgtcgtaaatctcgctgatcaaatccaaataatgaccaatgggaggtacaagagcgtggagcacagagtggcagtcaattgcgatcaaagcaggctatccatagctaccttttgcaatcctagcaatgaacttctgataagccctttgaaagagttggtgggtgaatctagtgagcttcagtacaaccccatgacctttagagagtacaggtccttcataaggaggataggaacaaaaggcaaatatttccttaactatgtgcaatcacctaaacactctgtattgccatccccatagcacatcttcttctaattatcatctcctctaccttgtaaaacaacccattttgttaaaaaacgtagaatgtgtgtgtgtgtgtgtgtacatata

SEQ ID NO: 2228 - DNA, 133 bp, Artificial; identical to SEQ ID NO: 1178
  Synthetic

SEQ ID NO: 2229 - DNA, 512 bp, Artificial; identical to SEQ ID NO: 1186
  Synthetic

SEQ ID NO: 2230 - DNA, 787 bp, Artificial; identical to SEQ ID NO: 741
  Synthetic

SEQ ID NO: 2231 - DNA, 249 bp, Artificial; identical to SEQ ID NO: 860
  Synthetic

SEQ ID NO: 2232 - DNA, 660 bp, Artificial; identical to SEQ ID NO: 751
  Synthetic

SEQ ID NO: 2233 - DNA, 624 bp, Artificial; identical to SEQ ID NO: 767
  Synthetic

SEQ ID NO: 2234 - DNA, 721 bp, Artificial; identical to SEQ ID NO: 781
  Synthetic

SEQ ID NO: 2235 - DNA, 643 bp, Artificial; identical to SEQ ID NO: 789
  Synthetic

SEQ ID NO: 2236 - DNA, 1098 bp, Artificial; identical to SEQ ID NO: 790
  Synthetic

SEQ ID NO: 2237 - DNA, 397 bp, Artificial; identical to SEQ ID NO: 794
  Synthetic

SEQ ID NO: 2238 - DNA, 476 bp, Artificial; identical to SEQ ID NO: 795
  Synthetic

SEQ ID NO: 2239 - DNA, 706 bp, Artificial; identical to SEQ ID NO: 811
  Synthetic

SEQ ID NO: 2240 - DNA, 610 bp, Artificial
  Synthetic
attaggaaatattcaatagaatatatctgaaccaacatcattccataagattcttaaaaacaacaacccttcttcttcagttacacagaagagaaacgaaactagagcacctaacattttaaaagatccccacgactatctatatctaccagacacatgggaacaaataaaaaacgaaacactcatatatgaaattttctttttttttcctatgaataaccaaagtgtgcaaggaaatgaggtctaattctcacctccaatgcaattcagtcgaatcaaagcctttgattattcattcagaccgagcagcaaacctttcaaccttacgggcattaaggttaattccaaccatagcttcacccaaaccagagctaacatcagcaagaatgtcaggatcgctataatgagtcacagcttgcacaatcgccctagcacgtttagcaggatcaccactcttaaaaacaccggaaccaacgaaaacaccatcacaacccaattggatcatcagagcagcatcagcaggagtagcaacaccaccagcagcaaattgaacaaaccatgggattgtagtccaccacttcatcccacacaaagtaatcgcttatgtcgt

SEQ ID NO: 2241 - DNA, 605 bp, Artificial; identical to SEQ ID NO: 851
  Synthetic

SEQ ID NO: 2242 - DNA, 589 bp, Artificial
  Synthetic
tgtactaacagtatatggaaatggagcaataacagaggcaaaaacctcaccattctctgttaaagtacgattaccacagatgcttagaggaggagtaatcatggatgttgttaatgcagaacaagccagaatcgctgaagaatcaggtgcttgtgctgtcatggcattagaacgtgtaccagcagatattcgtgctcaaggtggtgttgctcgtatgagtgatccacagatgattaaagaaatcaaacaggctgttactattcctgtcatggctaaagctcggattggtcattttgttgaagctcagattctcgaagcaattggtgttgattatatcgatgagagtgaggttttgacccttgctgatgaagaacatcatattaacaagcataatttcaggattccatttgtttgtggttgtcgtaatcttggtgaagccctaaggaggattcgggaaggtgcggctatgattcgaacaaagggtgaagctggaactggtaatgttgttgaagctgttaggcatgtgaggtctgtcatgggtgatatgaggcttgtgcgtaatatggatgatgatgaggtgtgttcatat

SEQ ID NO: 2243 - DNA, 530 bp, Artificial
  Synthetic
gcgggattaggagttggagaagaggtgatacgagatgtcgtacgatgacgtggagatagaggacatggagtggaacgcggagctcgaagcgtacacctatccatgcccttgcggagacctcttccaaatctctctgcctgaccttcgcttgggagaggagatagccagatgccctagctgctccctctacatcaccgtcgtctacaacctcgaagacttccaagaccctcggcccccgcctcgcccccaacagccgatcgccgtcgcctgatctttccagttgcttcgttcagtaaactcgacatctacattctatcctaaattgatagtcaccaaatgtctggtgcacttgagactgtttatctgacaagatttcatgtatcttggagttttgcttaaatcagcatgtagaatgataactgttggcttcttgatgtttcaaaggttagatattgtcatatctcgtgtgagttttttaaatttttggtcatgctagataccatgataatatattatgcaaggactatatg

SEQ ID NO: 2244 - DNA, 956 bp, Artificial
  Synthetic
gtcggattcaggcctcagcgctcggatcggcctcttttcctctcttccctctctgctttccatctgcccagcagaccgagtttggcagcgcaatgttgcctctatcggtgcggcgcgcggtggccgctgctcctcagggggcaagtgggctgacttctctcgccgcgtcggctccaaagatcacagcctcgagcttcatcctgaatcgtcctcagcggcgctactcctcgtcgaaaccctcaagatccgatgagcccaacgatattgctgccggccagtcggtgccggcatctacctcgcgcggagagagcaaaggcagcaggaaacgaaagagcaaggattcagccgaccgaaatgcggctttcaagaaactgcccagtgtccctagcactcaccacatgtctcaagaggccctgagcttatcgagcttcttctcactccaccgtcccatttccatcacccagaccatgcccaggactgttaccgacgagcactttgcatccatatttgcgcctcgatcaaaatcgaacaggatacgagacactgtctctacaatttctgacaccattgagcagctggaaggccccatggctcaggtgacaataggatctcaggaccaaggggctggcgatggtatgcacagagttgatgtcaagaaccctgacggaaccgagtcgagcatctatctccaggttgacaccatgtctggagacttcttgcctttccgcccccctccgctgcccgaggcgcagcaaggcattgaggctgaaggagttgcggctgaggctgaagctctggaagaggcagctcaccaccgagtttacaaggccatgttcaccattgaggagtccacagagtcagacggccaaatcaggatcatcgcccacagccctcgaattatccaggacgagcagccccggagcttcttggagcgtctggcagtccgccaactgcgg

SEQ ID NO: 2245 - DNA, 410 bp, Artificial; identical to SEQ ID NO: 2040
  Synthetic

SEQ ID NO: 2246 - DNA, 456 bp, Artificial; identical to SEQ ID NO: 1134
  Synthetic

SEQ ID NO: 2247 - DNA, 592 bp, Artificial
  Synthetic
cccacgcgtccgccaccgcgacactccccttcccttccttctccggtctcctccctctctcgtcgtcgtcgtcgtcgccgtcgccggctcgccgcgttctcctccgccgccgctgctgagccgggatggccgcgcgtagcccctacttcgtccccgagagcgaggggatccgggccggggagtcgccggccgcggcgctccgcaggatcctcgcgtcgccgggggcgcaccaggccccctgctgcttcgacgcgctcggcgcccgcctcatccagcgcgcggggttcccgatctgcttcatgggcggtttctgtgtttctgccgcacgacttggattgccagatgctggtctcatctcatatggagaaatggtagatcaagggcgtctgatcactgaagctgtatcactcccagttatcggcgatggtgataatggctatggaaatgctatgagcattaagagaaccgtaaaagggtatattaatgctggttttgctggaatcatgctcgaagatcaggtggcaccaaaagcatgtggacatactgaaggaaggaaagttatctcaagggaggatgctatcatgcacataaa

SEQ ID NO: 2248 - DNA, 599 bp, Artificial
  Synthetic
actccccttcccttccttctccggtctcctccctctctcgtcgtcgtcgtcgtcgccgtcggcggctcgccgcgttctcctccgccgccgctgctgagccgggatggccgcgcgtagcccctacttcgtccccgagagcgaggggatccgggccggggagtcgccggccgcggcgctccgcaggatcctcgcgtcgccgggggcgcaccaggccccctgctgcttcgacgcgctcggcgcccgcctcatccagcgcgcggggttcccgatctgcttcatgggcggtttctgtgtttctgccgcacgacttggattgccagatgctggtctcatctcatatggagaaatggtagatcaagggcgtctgatcactgaagctgtatcactcccagttatcggcgatggtgataatggctatggaaatgctatgagcattaagagaaccgtaaaagggtatattaatgctggttttgctggaatcatgctcgaagatcaggtggcaccaaaagcatgtggacatactgaaggaaggaaagttatctcaagggaggatgctatcatgcacataaaagctgccgtagatgctaggaaagagagtg

SEQ ID NO: 2249 - DNA, 239 bp, Artificial; identical to SEQ ID NO: 2056
  Synthetic

SEQ ID NO: 2250 - DNA, 154 bp, Artificial
  Synthetic
atactcggacccaagcaagattctcgctacatgctgctctgacgatggactaggatcacgtctggtggaagaagctaggttcccgtacatatgtttgggtggattcatggtcgcgtctagcttgggattaccagacactggatacattgccttc

SEQ ID NO: 2251 - DNA, 622 bp, Artificial; identical to SEQ ID NO: 1148
  Synthetic

SEQ ID NO: 2252 - DNA, 543 bp, Artificial; identical to SEQ ID NO: 1164
  Synthetic

SEQ ID NO: 2253 - DNA, 625 bp, Artificial; identical to SEQ ID NO: 1165
  Synthetic

SEQ ID NO: 2254 - DNA, 473 bp, Artificial; identical to SEQ ID NO: 1177
  Synthetic

SEQ ID NO: 2255 - DNA, 341 bp, Artificial; identical to SEQ ID NO: 1180
  Synthetic

SEQ ID NO: 2256 - DNA, 379 bp, Trichoderma harzianum
ttaattaactcgacccacgcgtccgtgaagatttgctttgttttctaagttcatttggtgcaattgagtcttctaaagcgtgctggtgcaacattcaagctgacgttggataaaccttcaaccgtaactcttgtacctctcaagacatcagaatcagatgatggatggattgatgaactgacctgcatctgcccactcaacaatttaatccagtcgagcttctacaacgccaatctcaaagctcacaactctgtattcactcatcttgaccaattctctttcagtttgacctcaatcactctttccctcatgaagaccgacgacgcagtgtcacaaaccaaaaaaataaaaaaaaaaaaaaaaaaaaaagggcggccgc

SEQ ID NO: 2257 - DNA, 506 bp, Trichoderma harzianum
ttaattaactcgacccacgcgtccgcatttatcgagtttcacagggcttagcaactcctgtccggggggattggcagatcttgacaactgaggaggaccggatgccgtgacgtgtagctgctaggatgaatcttggattggagatttgccagtcgatttggatggtgcctttcgggatggaggggtggagggtggagagatatgactagtgtggaggtatcacagcgtcggggggctgtggagagttcagggtaagccatttgcggctttcacgctcagtaacactcgggggtttaaaactgactgatggcccatctataccttgcagaaaaaatttaggtcctcgcaagactctccctagagccgcgtcccgtcactactgctgctttggcatcaaatagtgctcaatggctaggccgagggatttgaagacgatagcaatgtaacccatacgatctgactgaccgaaaaaaaaaaaaaaaaaaaaaaaaaaaaagggcggccgc

SEQ ID NO: 2258 - DNA, 1097 bp, Saccharomyces cereviseae
ggaattccagctgaccaccatgaacgtaacatcgaatgcaactgcagccggttcctttccactagcatttggtctcaagacctcatttgggtttatgcactatgccaaggcccctgccattaatttacgccccaaggaatccttgctgccggaaatgagtgatggtgtgctggccttggttgcgccggttgttgcctactgggcgttgtctggtatattccatgtaatagacactttccatctggctgagaagtacagaattcatccgagcgaagaggttgccaagaggaacaaggcgtcgagaatgcatgctttccttgaagtgattctacaacatatcatacagaccattgttggccttatctttatgcacttcgagccgatctacatgactgggtttgaagaaaatgccatgtggaagcttcgtgcagaccttcctcggattattccagatgccgctatttattacggctatatgtacggaatgtccgctttgaagatctttgcaggctttttattcgttgatacatggcaatactttttgcatagattgatgcatatgaataagaccttatacaaatggttccactctgttcatcatgaactatacgtgccatatgcttacggtgctcttttcaacaatcctgttgagggcttcttgttagatactttgggaaccggtattgccatgacgttaactcatttgactcacagagagcaaatcattctttttacctttgccaccatgaagactgtcgatgaccactgtgggtatgctttgccacttgacccattccaatggcttttccctaataacgctgtctatcacgatatccaccaccagcaatttggtatcaagacgaactttgctcaaccatttttcactttctgggacaatttgttccaaactaactttaaagggtttgaagaatatcaaaagaagcaaagacgtgtcaccatcgacaagtacaaagagtttttgcaagagagagaattggaaaagaaggagaaactcaaaaacttcaaagctatgaatgctgctgaaaatgaagtaaagaaagagaaataacatggcaattcccggggatcgcggccgc

SEQ ID NO: 2259 - DNA, 492 bp, Trichoderma harzianum
cccacgcgtccggaagcctgcatcgcccgccatggccattacgccgacccaattcgccaagaagacggcgcagtcgaccagctggtcggatgcgaagcgtcgagtcctttcttcgtaccgcgaatggatccgagctgcgcctgagatccagaccatgtacaatgtccctctccccatttctaccctccgaacacggatgcgacaagagttcgagcgacaccgatacacgaaccagctgtccatagttgacgtgcttctcttcaagtcccatgcagagtaccaggaaacaatgaacttctggaagcagcagactcacatcttgtcttatttcggcgaaaactttagaggtgacaagaggcttccgtccagcttcatggctggtttccttgagggtcgaaattagaaagacaatgcaagaaagtttgttttgtaaatatctctgtataaagattttgtgccgaaaccctccaataaaaaaaaaaaaaaaaaaaa

SEQ ID NO: 2260 - DNA, 900 bp, Trichoderma harzianum
gacacacagacgcactcacacactcagcttaagcgagcgagcgagtgaacgagagagagagacagagatggcgagtgttgcctccttcccggtgatcaacatggagaacctggagaccgaggagaggggcgcagcaatggaggtcatccgcgacgcctgcgagaactggggcttcttcgagatgctgaaccatggcatcgcgcacgagctgatggacgaggtggagcgggtgagcaaggcgcactacgccaactgccgggaggagaagttcaaggagttcgcgcggcggatgctggaggccggcgagaagggcgccgacgtgaagggcatcgactgggagagcaccttcttcgtccgccaccgccccgtctccaacctcgccgacctccccgacgtcgacgaccactacaggcaggtgatgaagcaatttgcgtcggagatcgagaagctctcggagagggtgctggacctgctgtgcgagaatctgggcctggagaagggttacctgaagaaggccttcgccgggtcgaacggcccaacgttcggcaccaaggtgagcagctacccgccgtgcccgcgccccgatctcgtcgacggcctccgcgcccacaccgacgccggtggcatcatcctgctgttccaggacgaccaggtgagcggcctccagctgctcaaggacggggagtgggtggacgtgccgcccatgcgccacgccatcgtcgccaacatcggcgaccagctggaggtgatcaccaacggcaggtacaagagcgtcatgcaccgcgtcctcacgcgccccgacggcaaccgcatgtccatcgcctccttctacaaccccggcgccgacgccgtcatcttcccggcgcccgcgctcgccgccgccgacgcggcggcggccgc

SEQ ID NO: 2261 - DNA, 164 bp, Trichoderma harzianum
cccacgcgtccggccaataggtggcctgcaggctgtttctgatacaaatcctcgtaatgcacagacgtgaatagtgctggcacaagtcacattgctgctgccttgaagggttccatttacattttggtgcagctctaccaaccgaaaaaaaaaaaaaaaaaaaa

SEQ ID NO: 2262 - DNA, 1314 bp, Trichoderma harzianum
tccaattaggcattgacagcaaaccaattccctccataactgggcctcttcacacccgtactcagaatgaccgacagaatattccgcatctttaacccgggagaaccaaagggtgatcccgttgagaagaggcgcgctcagctgcgacgtgcccaacaatcttatcgagatcgcaaggacaagtacaccaaggcgctcgaggctgaactagcacggtctcggaagagcgaggcgggcttgacgttccagatcgagcagcttcgtgtcaaagttcagaaactggccagtctcttgtcccaaaatggcatctcacttcctccagattttgacaatgaggaacaacttcatgatgatgtaccgcgtatagattcatctccgctcacaacgcgtggacaaccacaaaccgctgaaggcttcctatcaagtacagattcaacctctcctgagtcggtgacggaccaaggagctatcttaaatagtggaaaccgcactctacggcagtacagttcgagaatcttttcccgacatcatgaaccgcaggttccagcgccgacgaggaccgtccaagatgagcccggtgacaggactcgccttgctgaacttgatcccacacaggtcggaatggaatttgtgctcgcactagaaaggccttgtctaaaccatcttcatggaaaccccaaaaagcccctagaaccacacggccatgccttgacactaacagtccagctacaggcctccttgtcacttcctccgatcgatccaaagaaccctgtacctccgtcataccacaacgctcccgcagccgtactcgatcgcctattgaatcttgccccaagtgtatcaccagacggcgacgtgacgccgatccaagcgtggcattttatccgtcgccaaccgcaattcggatatttcgaggtgcagcgcctcaacaggctggcggagaggttacgggaagcagcaaagtgtcacgggtttggtgctgctgttcagacgggcatctttgaatcggctgtacgggaaatcctccaccccttggctataacagcagcttgacatataccccagaaatggggctacctaacctaccttttcttcttcttacaattgttaaacattatttactcaagtatcccatacatgggtcactggcaatattacatggagaatgatctcaccagaacgaaacaatatatacaactgcatagaaccgtcattttaaacgtgttcctttttcaagattggtactcgagatgagaagttttaatagattttttaatatcattcttcaccattcaaaaaaaaaaaaaaaaaaaa

SEQ ID NO: 2263 - DNA, 1154 bp, Trichoderma harzianum
gaacattcagccttgtgcaggggaagcagaagatcatatagagcatttatcaagcgaataacagaccctgagacactgaatcagagaagctttagaagctcttcttctctctgtctccgcgcctcttatcgcaaacagcccctctactgctgctgctgcctttgtcaggcctgtcttttcagtgtcgcatgccccgcctcatctttctaccttgcacaactcagcctttgcgctaatcaacgacatctgcgatctgtgtcggcagcagaagagtcccagatcactgtctctcttttattctccttcttctaaacagatctgtgttgcccccaaagcaagcgagaatacgtcaagatggctcttccgaaacgcatcatcaaagaaaccgaacgccttatggcggaaccagttcccggaatcagcgccgtgcctcacgaagataacctgcgatactttgacgtcgagatccacggccctgcatcgtcaccatacgaaggcggcattttcaagcttgagctcttcctcccagatgactatcccatgactccgcccaagattcgattccttactaagattttccacccaaacgttgacaagctgggccgcatttgcctggatgtgcttaagaacaactggtctcctgcgctgcagatccggacgattctgctttctatccaggccctcctcggtgctcccaaccccgatgatcctcttgcccccgatgttgctaagagctggaaagaagacgaggcggcagccatagcaacggcaagagagtggacagagaaatatgcaaaggcctagacttagaatcggaagacgagaggcaagaggaagaaaagagagatatatgaagatatattttcaagacctgcgataagttttgatatcaaaacggaagcttgctatggggtacgaacattattatgggaggagttgagagattattctttttttccattttctttggcttggttgcaaatattttagaaggctcaaatttgtttcgagatgagccgcaagcgttactgtccgcgcttctatggtgtatgttttagatagtacaagtggtcttgcagcagatataccactggcgcaatacatcatcacattacacttgctgtttagaaatacaaaaaaaaaaaaaaaaaaaa

SEQ ID NO: 2264 - DNA, 791 bp, Trichoderma harzianum
aaacaaccatgcctcacaaacacaagtcaaaaaagggcgaatttgaagcagaattcgatctcgcccctacagagaaagcgcgatctcttccagtaaacaaacgaaaagcggcatcaagttctggagagcaagtcacaaagaagcgtgccagaagctcattaagaggcaatgacactccgcgagcattcaagagaatcatggctgtggcaggggggaagaaaattagatcaggcttggatgatggtcaactcgacaaaacgactacgaaggctaccgatgtaacgagcgagaaacttcaaattcgtcccggtgaaaatttaggggcctttgccagccgggttgatgcggctctaccagtatcagggcttgcgaagaaaaccagcacgaatgcagagggcaaagacgcattaggattgaaagtgtatcgcactcgcaaagagcgcaaaatgcacaaactctacgatcagtggagggcagaggaatccaagatacgagaaaagagggaggaggagctagagcgcatagcagaacgcgacttggaagacgatgctgccggcattcttacttcagctgccttcgaaaacgacaatagccacacgaaaaagaggaaggggggcaagaggaagagaatagtagaggaagacccttggctagaattgaaaaagcgaagaggagagaaaaaggcaaaggttcatgatgttgtattagcaccgccggaacttcataaagtagaattaaaataaatagtaatattaatattaataatataagaaaaaaaaaaaaaaaaaaaa

SEQ ID NO: 2265 - DNA, 461 bp, Trichoderma harzianum
gcggtcgaataaacaccgactgcatctccatcagattgcgcttggcggccgggtctactgttgcagttgatgccgcccaactctggcaaaacctggcgctgcggctgcggctggagaccgggggagcgattctggctgcccaaacgagaaccgggggggatgtcaatgcacagttgcatcgaaatttggcgattaatttttttacgagggaggattaggattaggactttgcacggtagtattactaggacccctaggcagaaagttggatatagattgcattggatgttttgattgagttgccttgctgggatgttgagagtctatcaagcaagcaaggcagacgaggatgccttgtgcagagacggcatttcaattcactaattggataaaatagatatcaacgtattatacagaaatactgcatgcaaagtaataacgaaaaaaaaaaaaaaaaaaaa

SEQ ID NO: 2266 - DNA, 372 bp, Trichoderma harzianum
catgtggccacgggaatgacgcaaaaggcgccgagagcggaaatggagagaaaaaaaacccaattgcacctcgtgatgatgccactcaaatgtctgtggtcgagccactggcttctacctacgcttacattacctaacaaggaacgaaacattttgcggcaaggagaattggatcattgacttggcgaatggcctaatgaatgtcgtcaattgcaggcctcgtggtttggcggttggatgagagggggaattggagtgagtgggatggggagttggagtcattggattcatttgacaattggttattacgagcggtttaggtaagaatgtaacaatggaacagcaaaacgtgcacgcaaaaaaaaaaaaaaa

SEQ ID NO: 2267 - DNA, 319 bp, Trichoderma harzianum
ggcagagctacaacggccctagcacacaattggccacaattcacgcctcacaatcgccaagattgctctaattctcgggcagtcaagtcttgtcaagtcttgtcaagtctcgaactcgtatccttgagcatatgcaggtggcgtctgtgtctcgagacaagagagggtgaacatgtgcacagaacaaggcaccgaagccgaaagggacaaaccgaagccgaggtgggaaaaaggcgccacgaaccagtatccaagagtttagccactgtgtcctaatagaatccccccttcttttttttccttcaaaaaaaaaaaaaaa

SEQ ID NO: 2268 - DNA, 349 bp, Trichoderma harzianum
gaggtgcttgttgtctgtttctgtctagaggtattggatgtaaataagatcagcacgagatgagatgagatgagcagacagacgatcagatggcgagattgagaggcaaattgcaagtgaatttaaattgcttcgctggcgcctaaattggaagcatccatggctcgccttttgcctccccacgtgtggaaagtagagccgagagcgatccctagcggctattctattctggcggtttggagtcaatctggccccccggagattgagatggtggctgtcgaggtgccggatgggatgggatgggcttgtctttggatacttcatcttttcatcaaaaaaaaaaaaaaaa

SEQ ID NO: 2269 - DNA, 219 bp, Trichoderma harzianum
cggatggatacttgcagtaatatggggtaagtgagtgagtgagtgagtgatatggatacagcgggatgatgatgatggtggtggtggtggtgttgtcactgatgttgtcgagtgagttgtttgttttgtttacctttggaattgattgaaatgaaatgaaatgaaacagcccaatgcacagcctaagtccaaagaaaacaaaccaaaaaaaaaaaaaaa

SEQ ID NO: 2270 - DNA, 402 bp, Trichoderma harzianum
cgaagcatatcgggctgaaacccccacaacgggaagacgggacgatacgaggcaatgaggcaattcagcggccggtagctgtcgggatgttttttccccggggaatttcgcggtggctgacacttggcgtctcgggaaatgatttgacggatggatgcctaagaaatgatccgactgatcaggtacggcttatcggctgttaatgacgcagcataaacaagttgcatgtgtatcctaagagcatgctcgccagatgtagatggacagagggcacaaggattggaagaatacattgccaatagtggttcatatagggagtaactacatgtatcttacgcttgagcgcctgcttttaagtagctatgtagtacagatggaggaagcaccaaaaaaaaaaaaaaa

SEQ ID NO: 2271 - DNA, 309 bp, Trichoderma harzianum
caaaccggcaaagaaataccctgcagtcctcgagactcgcgatagagcagaagtacatcagtcttatttactagcgagcaagacagtcaaaatgtcgtgggcgggtacggagcttgcggatgccccgctgagagagagggagaggggctgacgggattctaggattcaagaagaatgtgaaccgcgcgacgacgcaggtgatgatgaagacgggtgagcagcgttggtattcattcggttgggatagcattctgatcttgtggttgcagggcatgtggaaaagacaaacgatcgaaaaaaaaaaaaaaa

SEQ ID NO: 2272 - DNA, 399 bp, Trichoderma harzianum
gcgagggagaaacgggtatgggctgggggggccgcactagattctttgacgtgtcttgtacggaattccagcgcggtggaagggtgtggctgctgcacgttttcgggggccaggttctttacactattcccacggacaaggttcccaagtgaggctgatggagggtccgcgggccttttggggggggagggtccaatcgagtgttgtttgtgtgttcaccaagttcaagtacatgggtatgcgtatatttcggccatgtatgcgcgatggattcctggtgttcggcagcgagcatgagaaaaaagggaaaatagactgcgagagagagagcgacaaaaagaaggaaatgctccgatcacgattaggggcggaattggaaatccgaaaaaaaaaaaaaaa

SEQ ID NO: 2273 - DNA, 496 bp, Trichoderma harzianum
agaagatgaagccggcgttactgcaacggcagtttggtaagatcaagtatgctaatacggtgtttagggtgtgatagtagaggcatccggcgaggcggctgagacatatgagggcgaaacaggagtagaggagacagtggcagcagcagcagcgttaatggcaataacaatagatggcagagaacggccgggccctcggattccctcttgagagcgaaggcgaaggtgaaggttcagctgatggataaaaccgggagacagccgagcgacgcagaggatgtcaggcgtaggttgcgtgagggtggctgcagaggccgagagcaggttcaatcaatgggcgagagacggctaatcgagcagagcgtgacgaggagcgcggcaatggcgagtgcgtgaaggggtgttgattcaagactgcgcgcgtgagggtgtgggagagatgaggcagaggccagaggcagctcaaaagggttcaaagttgaaaaaaaaaaaaaaa

SEQ ID NO: 2274 - DNA, 346 bp, Trichoderma harzianum
ggctgacagatgctctatgacggagaggcgaagctgggtcgaagcagacgggcaaagcgatttgaaatggtgaacaggggagaatttgctcgctggccaagggggaagaaatgatgagagaaagatgagaagaagaagaagaagagggaagagaattgctccagcgggatgggcagaaggtggtgtagggacttattagtgactgaatggatggttccggcgcggtaaatccaagtgggtggaagtgacgtgcggctgctgcgcctgcaagaggctagcagacagcagctaaacaggacctggtagtgggttcagtatgtaatgcgaaaaaaaaaaaaaaaaaaaa

SEQ ID NO: 2275 - DNA, 420 bp, Trichoderma harzianum
ggcggatagttgtgctatcgttgtcttcatgttttcatgtttgcacatagatacgagaagagttgtgggagttggttgcgtcatgacataagttgtaattatagtatttgctgattatagctgattacgcagggtgtgtttcctagttgtgtggatggatgtgtgttgatctggccccctgcatatttcggagtaaatcatcctcccgatggctatagtcgagaggttaatgggctctactcgagttctgtcgtgtaacagcatccataaagacagtcataaagaagttcttgagtcatttctgattctccctgtcaacatcatgattcatccaactgaggaaccataatgagcttgtataaacactcactaacctcattctagagcatccttaagagggtctctaaaaaaaaaaaaaaa

SEQ ID NO: 2276 - DNA, 203 bp, Trichoderma harzianum
tgtgaattcgcgagcgaatgaaactcgtcgcatgctttggatcctgcttccgacaagctcccacgacttggcttggataaacctctaacctccattttggaatcgagtgtcctccatggctcgagaataagtcacatattcaatcaacagtatacatagttgtaatcgatacaccaatttctactggaaaaaaaaaaaaaaaa

SEQ ID NO: 2277 - DNA, 321 bp, Trichoderma harzianum
acgagaaaaaggaacaagccgcgggttctcaaagtcttccggtgccgccggccgtttggctgcggaccgaaaggtggacaggaatcaactcgtgatgagatccgggaaatggcggcctccgccgggatttggattccattctttcgttttttgttggtttctaacgttgatgaccattcagtggcggcggctatgaaggatatgatgagaggtggtgcttatgccggtgtgtatcaagtaacgagtccgcctggtccaggcatcatcatacgatccatcaatcataatcaaggggaacacagaggcaaaaaaaaaaaaaaa

SEQ ID NO: 2278 - DNA, 431 bp, Trichoderma harzianum
cgaccattaccatcatacagccaacctctacataagcacaaataccattcaaaatgtcttacggcggtgacaacaacgacaactctcgccgtaatgacgacaactttggctccggaggagattctttcggctctggtggaaaccagcaatatggctccggaggagactcatttggctctgggggagattcatacggctctggtggaaatcaattcggctccggcaaccgccgtaacgatgacagctcatttggtaccagtggccagggcgagttcggctctggaggtaactatggcagctctggcggtgactcctatgggtctggaggaaacacctatggctccggcggcaatgacaactttggctctgggggcaatgatacgtacggctcgtcccgtaaccaagagtcttcttttggatccagcggccgc

SEQ ID NO: 2279 - DNA, 689 bp, Trichoderma harzianum
tggggtcgcaaatctacagcaaaaatggcctcgacaacgaccaagcagaccccggcgtcctttgtcgggaccagcaaggtcgtcgagactgactatccgctcatcgacaacgaccctcactttaagcgggttatcggatatgcgagaacgtcagactacgtagctggtgcaacctctgcggcctttgcaccgactgctctctatgccctcgagaggctcgccccgtcgcatgttggccggggaggctttgccaaagccatgcggttagccggattcattggcttggccggcggtttcctctacttttaccagcgatcagcccttcgattctacggcgccactgagaactcaagggaagtcgagatggatatgcgagagatggtttccaaggtcaaggcgggacagcctctgtatggcgagagcaagctgagccctcacctgcagggagttgcggcccgacagagcagatactctgcgctctttttcagcacagtaccgtggttcaactttgtcaaccacaaccagcacggcgtggacacggccaagtactatcagcaggccgagagggaactggaagcagagcgggcggcgggcaagagctagacgggaccaaatgtgtatatttagcgggactaccacttcttgcggagaaggaaaaaaatattggaagcttcaaaaaaaaaaaaaaa

SEQ ID NO: 2280 - DNA, 297 bp, Trichoderma harzianum
gtttgttagcctttgtgatgcaatagcatgttgtaagattgtttgtgtaagtgaagtctatagcaatgcctggaatgtgatggaacataggaatacaggatggatgacagagttggtgatggatatgtacacttaccctcgctgatacggcacgtcgtcaacggtctggtattcttgtggctggacgatagacattgttgcggttttcgaacggtttgttatgtgcttcaatggtttcttggctttgtaagttgtcacacgatccaaataacccaaaatcaccaaaaaaaaaaaaaa

SEQ ID NO: 2281 - DNA, 906 bp, Trichoderma harzianum
atgctccaccattgcttgccttatcgcattcaaggccaggtaacgacacttgctgctgagtcgaacgcaacaccgccttcaacagctcctctgcaagtctcccgcaaaaggacaggctcagtcttgtgtgggcagcatgcgcgtcattgcccttttctcggccctgtgtgccgcagctctggtccaggccgatttccacacggcgcaaatctatgtgcagcccgtcgaaaactccgagtcgcccagcctcctcgccgaagtggcatacgatcctagcatcagcgggtcgtcctctatcatctcctacgaagctcctgaaatcccggagtctacacagctggtccgcgtcgggttgtacgacgtcaagtctgcgcgatggatatctggcacaactgttgcctcggtggacaactttggcaagggctactcgcccaatttgatactctcagtcgatgaaaagggagagcttctcagtgctgctctcaagggcgtaaggatcgatgcgggtcagacgagagacttggcccgcaagcggtggtgctgccggtgctcaagggcaagcagccagagctgaacaagccaattgttctatcgccagaggggaagaaggttgaggaggttgagaagacgccccttcagaaatactggtgggtgattgccattatagtgttcctggcagtgagcggaggaggcggcgagaaatagagccggcaattgacacatactgtacatcaatctgaatatacgcttccgtgatgggatgaccgctggcaagggttgagctgttacagctgtcagtgatccctgtcctctcaccactgtctaggtacatgactatattgtttgtctttgatacataataccctataataagactattgcctgttcaaaaaaaaaaaaaaaaaa

SEQ ID NO: 2282 - DNA, 654 bp, Trichoderma harzianum
ctcactacaataaaaacacaatcttcaattctttgaacctttttcaagtttcgccaacatgaagttcaccactactgccgttcttgccattgccgcattcgttgaatcggccactgctctgggcaaggcccgtgtcgtcaacaagtgccccttcagcgtcaccacctggtccgttggcagcgccatctccaacccaacaacccttgctcaaggcggttcctatggcgagaccttctcacgagaccccgtaaccggcggtcgtgccatcaaggtcaccgtccagcccgatggcctctacactggcaagccccagaccaacttcgccatcaaccttgagggcaacaccatctggtacgatctttcagatgtctttggcgatgccttcaacggccacaaggtcgttgtttccagcgccaacactgcttgcccccagattgtttggggcagcggaatccctcctgccggaagccaggtcaagaactgcggtgcggataaggatgtgactttgactctgtgtgcttagagttaagggaggacggaatcatgtcaagggaaaggtttaaatcaagtttatgatagaatttcaagtcctagctatgtttaagacttatgacagtatgaattgatgagtttacttcgaaaaaaaaaaaaaaa

SEQ ID NO: 2283 - DNA, 297 bp, Trichoderma harzianum
tgatgatgaatagaatgatggaccaagggaatggttggtaagatgttctgggaggaatctgtgtttttctcagggtgagagtgtataaatgtgtagcgtgtacatgtgttgaggctcgtcgatacccggcaacatgatgactgtgcgccaccggccattgatttgtgctgatctctgcttgatgaacactgccctgtttacactgtcgtgtactgttagtatgtccatcgtgaaatggtggtgtgcgatgtttgtcgcgggctatgaagataaagcaatgagaaaaaaaaaaaaaaa

SEQ ID NO: 2284 - DNA, 654 bp, Trichoderma harzianum
cctggatggggtccggactggtctcactggattttcttcttcttctttggctgtcctccggttctttcgggctcgggctctggcggtcttcgcggcaaagggagataagagcccacgtgcgaatttacgaaagccctagcgctgatcgggtttaaagcaagtgacgtgatgaatccgagttcatttgcataaaaaaaaaacataaaaataatagagccagagatttgccgaccagggcagggggcgcaaccatcttcatcgtccatcttcgagtgtgtgccacccggagcagcaaagacggtgcctcggccaagagtcaaatgtcaaaagatggagatgcaatatcacggaagccgagctccacttgatgctcgggcggcaagtattacacaatggcaagagatccggggtaaacaccgcagtcccggccgatcctcgaggcctattggatgagcgttccggcacccaaagggatttttcggaaccgatggtcggggattcccacccccagcttgctttctcccatgtgtctgtgggccagaaccagaatgcggggagtagatacatagatctagaattgccttgagatctcctgatatttgaagaataggaaattttttaacctttaaaaaaaaaaaaaaaaaaaaaaaaaaa

SEQ ID NO: 2285 - DNA, 773 bp, Trichoderma harzianum
cgagagacttgcgcttcggcccggcatttgcacattttgagaaccgaaacgaagaagaaaaaggataaaaaaaacatggcttctaatcagtttgattcccaggcctcgaccaactacaaggaggcttttgccctgttcgacaagcgcggcaacggtcgctgtgccgtcgactcgctgggcgacctgctgcgagcatgcggccagaaccccacgctggctgagatccaggaactggagaagggccttggaggcgaatttgatttcgaggccttccagcgcatcctgaaccgacccggcggattccgcgaccctggcgagcccgaagaatactgccgtggcttccaagtgtttgataaagacatgacgggctttatcggcgtcggccagctcaagtacatcttgaccaacctgggcgagaagatgacggaggaggaggtcgacgagctgctcaaggccgtggacaccagctctggccagatcaactacacagatcttgtccgaactatcctcgccaactaagattccccttgtacgaagaacctaacccccggtggtatctaagtgcatctgcgaacgggatggcgttgctatgtgtttgttttgattatggcagtgaaattgggcacgcttgggattgatgaatttttcttttgtacgggatggccgtagactttgtttgctaccagtggaatatgaacatgtgttggtacttggagtgcacaatgaaatgagtcggccaagcactaaaaaaaaaaaaaaaaaaaaaaaaaaaa

SEQ ID NO: 2286 - DNA, 386 bp, Trichoderma harzianum
gaacaagccacatcggggagacgggaagatggtgacacggatgcgtttgtggaggtgggtaagctttgcgcaacatgtgccagccttatcttgatattggacgcggcgacggcgaaatggttggaagggtgtgtctatgtgtaccgacaaacgcatggctgatgagacggtgaataaaactgcaccaagaaagagatgcatgagagatgaatgaccagtacctaaggtctatgacatgtcgctttgcactcggtcggactcattcacatgtagtaaatactacataacacccacttgctccagtaatcatcacttataataatacggcgagaagacaagttgacacagggcgaaacagggcggaacaaggcaaaaaaaaaaaaaaa

SEQ ID NO: 2287 - DNA, 360 bp, Trichoderma harzianum
aatcaaactcttaatctctattcttaaatacatctacctctcacaatggatttcgtcaacaaggctatgggcaaggaggagcgctccactcagggcaccgctcccgctgctccccaagcaggcggccaggtccagaaggacgattacgtcgacaaggctttcgccatgggtgccaaaaagagcggccacaacatggatcgcaacacacaggagaagattacggatgcaggccgtaacatgtacgagaaggtgacaggaaacaaggtcgaccccaagtggtctaattaatgaacggacgagttatgactcacaacaagactgtacaatagtaataataacatcttaccaaaaaaaaaaaaa

SEQ ID NO: 2288 - DNA, 372 bp, Trichoderma harzianum
ataaattcgaggtgttttagacgcaagcttctcttttacacactgaagctgctgctgcaaccatcaccaacataccacacgcaacaacacaacaccaccacgtaataacgagcagaacacccctcgcttgaacttgttgcaaaaaacactctcgcctctatttcataaatcaaattacacacgaacaaaacaatgaatccaacagtcagaggcttctcaaccgccgcaagagtgcacccgccctttttgccacatctccgcccatcgccgcgccgagccccgatccgacgctggtaagcactcaactctctctcacgtcccccatccataaggataccatagcagcaaaaagacacaaccaaaaaaaaaaaa

SEQ ID NO: 2289 - DNA, 558 bp, Trichoderma harzianum
tcttacagtatcactactccatctcagttcgtgttcttgtcattaattaactcgacccacgcgtccgcccacgcgtccgcccacgcgtccgaaacaaccttcttcatcaattctactacaacgaccttcctacttaaacaatctctcgataccaactccccaagatgaagttcactctcgtccttgctacctttgccgccgtcgtctacggtcaaaccatcgatgacattcccgcatgtgctcgtacttgcattgagaacgccgttctagccgctggttgctcgtctggaactgacgtcgcatgcgcttgcgcacatttcactgctgttcagaatggctctactagctgtgtcattgctgcttgtggcgtttctgtcgccattaaccaagttctgcctgccacccaggctctttgtgccaaccagtgaactcatccatcgagagggagaaaatgacatgggagaaaatcaggtactcttgtacattgacaaacaagtacatagctgaatggtgtgaatgaataaaacgcattgctgctggaataaaaaaaaaaaaaaa

SEQ ID NO: 2290 - DNA, 373 bp, Trichoderma harzianum
agagcatcttcctgacatgccggggttgatgcaacgctttgactgtatggaaacatccgtattgctgacatacatgtcttccatgttgtcttacactgcactcaggaggagcagtcatccaccgagttgattcacatggcagcaaaattgtgctggatctactgcagcgcagatcctctatttgggcatttcttctcggagacagacacagatcggctcggcgaacccgagagcaagtgatagcaagacaagcacagatatgcttggcgaggctgtcctcaccaggaaacgaaagaggaggtttcaccagcaactccattcccagcagaggtcagcctgtcctacctgtcacattagaaaaaaaaaaaaaaaa

SEQ ID NO: 2291 - DNA, 241 bp, Trichoderma harzianum
agataccctccccttcttcttctcttctttcccccccttcacatttgtgtcttgacgtcgtatttcgcttcagcgtcatcccccatcacacatacacacatagcaacttgccgacgtcatggctgagcaactgagatacgacggccaggtcgtggtcatcaccggagctggcggtggtctgggcaaggcctatgccactttcttcggctctcgaggcgccagcgtggtcgtcaaacggaac

SEQ ID NO: 2292 - DNA, 321 bp, Trichoderma harzianum
aatagagggaaaacaagaagcgctgcttagccccgatcatgcgtacaatcttcacacacttgtgtcagctcataccaaatcgagctgggattggttgcctctgattcggggggtatggcaagaaggcacatggtctggaagccctgagaatggccgctgatttcgtctgtggccaacacgagttggtgcccgacgtggaaggcattgcctcgtcgaaccgcagagcaactttgctcataagacaaactatgagcgctgtgtaacatatcctttgcgagattcggtgtgtgatcgctggctgggcggggaaaaaaaaaaaaa

SEQ ID NO: 2293 - DNA, 245 bp, Trichoderma harzianum
gtttcggaggctgattgagtcggaggggctgccttattgcggcagaggaatagtgacgtcatgactatcaaggaccctggaggttacctaaaagaaaagcatctggacgaggtgacgtagccatcaatgcgatcgattgtttgctctatctcctcgggtcggctgttgatttagtattaaactaatggatatgaatagtgttagagtgtgcgaatggatctcattgtttgaaaaaaaaaaaaaaa

SEQ ID NO: 2294 - DNA, 583 bp, Trichoderma harzianum
gtttggcttgcagtaagaccggcttatgagaaagaccattgtgagagatgtaaggctgatccggagctctacgtcatctgagacatgacattggcatgatgagggtccagtaactacctgatgattggggtaatcgaaagagatgcagagagaaacacgcaactctgagaaagcgtcccgttacacacggaacacactgcctccggacagcggcttgtggctcattgcttgagtcccttaatcagcaatccccaggttctcttgacagctcagcggtgcagttttgcgggcacagctgatccacccgtcaacggggcgggacgccgggaagccgggactccggggctaaaatgacatcgccatgacatccgcaccgtccgaccagaactgctactactcaagacggtaagcaagtgctagcaaaagtgagttttacgaggtaagcaagtaggaacgtggcttataaagccacagctagcttgaggcgaaggctgctagtaggaactaaagtcagcttatactatttataagctcactgcatgggctagtaataatagctcaaaaaaaaaaaaaaaaaaaaaaa

SEQ ID NO: 2295 - DNA, 1190 bp, Trichoderma harzianum
cccacgcgtccggcgtgaagataggagagaatagagatagagaggcaattgcacggaatgtttagccaacaagttgctcgtggcgggcgccgcatcggccagatggctcgaggcggccaatatccgtcactcgctgcgctcagaggagctgctcaacgacgatgttatgctgaggctgcacaggcagcccccaagggacgtatcggtcgaggcctcgggctgctcctgtatggcgttgcatttagcggcctcggagcagcagcaacattctattcgatggtacaaaagggtttcgcctcgttcaccgacgccgagtcagccaaactgtttgtcccagatagcgacgagctgcaacaaatcgaagagacaatcaacaaacacccgctcgtccaagagcttcgatcacgaccagagttcaaggagtcacgaccacacctaaagatgtcaagcgaagtccgcagccgcaccctcaccggcggcgctctacaaggcgacggcatgatcatggtcccccccgtcgccttcatcgaggacggcggcaagtccatcgtcagcgtcacgtacattggcgacaaactatgcggccacccaggcctcgtgcacgggggcctgctggcgacgatgctggacgaggggctggcgaggggctgcttcgacgcgctgccgcacaagattgccgtgacggcgagcctggagatcaactaccgcaagccgacgcaggccaacagcttcctggtgctgcgcggcaagacggtcaaggtcgaggggcgcaaggcctgggctgagggatgcattgagacgttgcctgcgccgggcgagaagccggtcgttttggttgaggcgaagggattgttcatctctcccaagtatgcggcgctgatgccccgaattacctaaatgatacatgcggtggagtataatggcgagatgagaagacgagcgcatagagctgcgaagtttttgttttgcacccatttttctatgtttactttgccctttttgacattttttggaaagcgacggcgggaatagattatacatactagaactgcacatattttaacagcgaggcagtagacgccgtgctagaaagcagagaggagattgcttgttcgtctttgcagcagatggagctgagccagatgggcgctttacatgatatacctctagtaaaaaaataaaaaaaaaaa

SEQ ID NO: 2296 - DNA, 772 bp, Trichoderma harzianum
agcaaataccgcaaagatgtctgacgacgggctctcaatatacgatgagatcgaaatcgaagatatgaccttcgacgaggttcttcaaacatacttctacccgtgtccctgcggcgatcgtttccagatcgctatcgatgacctgcgcgacgagcaggatattgctgtgtgccccagctgtagcttgatgattagagttattttcgaccttgacgacttacccaaacctcctcctactggcaatactggtggccagataccagtcgctgcttaaagccatcgctatatttgagcttccctgggcgaatacttgatctattcggcagacacatcgagatactacactaattaggcccgcatagcgtacacagtgcctcaacggccgttctgaagaggcttctcagattgatccgtctaacatcggatgtattgatagacgcggacgagaagacgacgatgtaccagcgacagaccaaagtcatcccaagcatccaagctactgatgcaaaaatatgcgtgccttgggagtaccactctccgaggcaaaaattcagtcacttaaagagacaggcttcgggaatgccatgaagaattcaggctcacgtgggggacatttgatgaaagaacactgccgaggcgttggcaatacagaatggacctatgaaggacggccatttcactcatataccgtcaacataacaaaccaagataccaagggtgtattacatattcacctaaattccatgaatgcaaactgaaaaaaaaaaaaaaa

SEQ ID NO: 2297 - DNA, 1521 bp, Trichoderma harzianum
caaacaacgaaacaaccgcccaatcgccaatcgccgcctcgacatggtgctcggcgactacgaggaagcacaataggcgggacgcgaagcaaacaagcgctgggcgtctgagaagtagcccgagagtcacagctacagctacagctacagtgaacacgcgatagagtgattcaggacatccagagacgagacgaggcgcctgaacgagatacgaagcaaacagacacgggaaagcagatgcaatgtcggcaaacgtaacaaagccggcgcccaatcggccgcagcggcgcgtaacggccggccagatcctgtcgatgccgccgaaatggctcggcatgtacgacgaattcatcaccaagaacgccggccaggtgtcgcagattgagagcgcgctgaggagcttgacgtatatcattccaggccgctttcgcgatgctgaaatcgcctccgagtcgattcactcgggcgtccagctgctgtcgctctaccacgacggcatcctctcgcaggcagtgtccaagctgcccacgccgcctgtccggtcggctcatgcgcgctacacgcgatactggacgcagaagagcaaaacgtaccgcaggatagccatggtgctgcagatggtcgtctacacggagctgctgtgcgaaatgagcgccaagcggcgcggcggcgaaaagtcccggtggaacgtcatcgtgctgctcgaggccatcaaggccttttgccgcctcatcctgctgcgcgtgacgcggtcgcgcccgctcgtcacaccggtgctgccggagcgagagcccatccccgaggacgacgatgtcgacgaggatctgattacggccaggagcgagagcgagctgatggacgagacttcgcccaacggatccgccgtccttgtcagcagcagcacgccgccgaagcctgcgtacgagagagaatggacgatgccgcggacgggaatgagcttgccgtcgttgcccaaccctggcgatgttggctcgtacctcttggggcgcgtcttgacggccgacgacatcaagcctgccaacaagctcctcaacactttgcaaggaggcggccagtttgccgagatgctgcacattctgacgcccttgatctacgcagtggcgctggctaggacaaagaataagaagtcgtggacgccgtggctggtgggtgtggcggtcgagtatgtcgctcgccagctccgccagcgtaacctgcgaacctcggctctggagcgagacgagtggaacaagagaggctgggctatgatctggtggatgatgcgcggtgctttttacgagaacgtgactaagggggccgtcaacggggtgacgagcagaatgccaggcttcatcggcggaatcctacaagactacgaatatctgtgggagaattactactttagcacgagtggctgattgactgtcatgccagccgtggagcggtggcgctcgttcctcttctctctcgccatataacttatattggtgctaccgaagcacatgcaaaaaaaaaaaaaaa

SEQ ID NO: 2298 - DNA, 355 bp, Trichoderma harzianum
ctctcgcctcaaaattcatgcgcctcaaagaatggaagaaaacacaggcgaatgacgtgaaacgaaagataaaaagacaggcgccttcatgcgagggtttcgccagtcgcctctagcgtgtttcgaagcgcagggttgaaacgcggctgcatgatgcccggccgcccatctgaggcatggcggctaccggaacaggacgacatccgaagacttgaggaggctccgtgtttgttcgtttcgtttcgtctttcgagtgaagggttggttcttgttttcggctgttgtgtgttttggttgacttgtgtttacgggttgggggtgagttgaattgagtgcgagactaaaaaaaaaaaaa

SEQ ID NO: 2299 - DNA, 1722 bp, Trichoderma harzianum
ttttttttttttgtggatttttacaacgttctcttcgtgaaaagcctatccttctttacttctaagcctctcctttgccggtcctttgagatatcattcttttattacacaaccctctttattgagcgaaaatgatttccaagacgacttttgccgtgctctttgcagcccttgctgctgctggccccatccaattccgagaggtggcctctcttgacccagctgctaccgctgaggcccatcccagagacgacactgctacccgcgccttttccaatgtccagatcaagacgcaggcctgcttcaactttgaccctcgacgtgcagccggaaaccaggtcctgctcttctcgtgcggtggacgggctgatggcggcggacaagtgaccaactctcagctctttgcctttaccggaggcaatggcccgctgagcttcgcccctgagaacgatcccacaaagtgttttgctgccaagggcaatgtcattgacattgctgactgcaatgccaatgatgccacccagaagtttacctttggtggtgctgctgccggaggttctggcaatgatagcaacaacaacagctctgccgccgccagctcggctgctgctacatctgaggctgctgcctcttccaccccggccgccgccgtgacgaccgctgctgctgctgcttcttctgcggccccggcgaatgacgacaacgcccaatgctctgctcccaaaattgttaccgtcactgaggttaccactgtcactgcgggatctcctcctccagccgatgccagtcaaactgcggaggctgctgctaccacttctgctgctgctgctgctgccacaagtgacgcagtcgttgtcaacccaggcgagggcagctcccagaccactgcagctcctcctcctcccgtcatcaccggaaacccaacgacccccgtgcccgtctccggagctggaggcaccctgaacccttctgccgtggccgaggcccaggcatttgatgccggcgccgttcgacccctggagagtgtcaacatccgagccgccgatggacgctgcttctttgtcaaccccacggccggtgatttccgcgagaacctgatccccgttggactggctacctgcagcgaagacgcgagccagaagtttgacgttgtcaccaagggagtccacgacgacgctcaggccggcgaggcgctgcttgtcagcgtgctcaccaacggctgcatcaactttgatggccgcagagccgccaacgaccaggtcatcatgttttcttgcggtggacgcgccgatggaagtaagtcattgacatcatttccccccaccccatctcggtgatctgctcgatccacccgatccaagggcatgcgagttatcgcgtttgtaccgttttagtttcacaagagatcaaatgctaacgatgaacctcaacaggtggcaaaaccgcgacttcgcagctgttccccttcaaggcgggcgacaacaacatcatccttactcccgcctcggccaccaacacgacttgcttggtcgctggcgctgaccgggtggagtctgcgcagtgcagtggccagaaggatcagacctttgaactggtggagattctgtaagaaaaacatgtgagagtgagagtgggagtgagaatgagggtgagagtgagagtggctcgtttcacgcggacgcgtgggcggacgcgtgggtcgagttaattaatgacaagaac

SEQ ID NO: 2300 - DNA, 1226 bp, Trichoderma harzianum
attgagtccctaggccagaaccgcgcgagtatacatctatctgcaacatctcttacctccatcttcgcaatggcttctgataagatggaccgcggcctcgacgaaatcattgcagacaagcgcagcaatggatctcgaacccgacgcggtggcgaccgccgtcgtgaccgtcaagactatccccgtgatggggtgaaaaagtctctccgcaacgaacctcgaaacttggatagcgaatgggtacatgatcgatacgaagagaacacgtatcgcaatagaggccctgcaccgcgtcgcaggcgcgagtctcccagcgggggagatgcccgcggcgcacgactccgagtcgaaaatatccactacgatctcaccgaggaggatctcgatgaacttttccgaagaattggccccatcacaaaattgcaactgcgttatgatcggtctggacggtccgaaggtgtagctttcgtaacgtatgagagcaaagacgatgccgcagaggctgtgagacaattcgatggtgccaatgcgaacggccagccaattcgtttgtccgtcatgtcaagtgggccttctcgaaacccgtttgatactgctgtgatgccaggcaagcctttgtccgaacgcatttctgctcctggtggcagatctcgatcactctcccctcgccgatacgatgaagaagatgccgctcgcagaggcattgatcgatatgttccaggcggaagtcgctctagaagccccatgcccccccgccgtggaggggggggtggagggcgccgccctggtgcccgacgagagggtggaagggatcaggatgccgctcgtggcggccggggaggcagaggaaacggaggaagcggaggaagcgaccgtgctgcacgaacaaacacaccgcgactcaagaagacccaggaggaactggacgccgagatggaggactacttcaacgccaacggcggtgcccctgagcctgctgcagaagctgctgctgcacccagcggagaggctactgcacccgttaacgctgatgacattgacatgattgagtaacctggatcattgtgttttggtaaaggggaatgtgttttatgagggtattggagtattggactcgttttacagaaaatgccatctgaagcatgggaggacagtgcatatatataattaagcagggtgtgttgtcattacgaatgtattgcttttcgggccaaaaaaaaaaaaaa

SEQ ID NO: 2301 - DNA, 1364 bp, Trichoderma harzianum
tcggatcggcctcttttcctctcttccctctctgctttccatctgcccagcagaccgagtttggcagcgcaatgttgcctctatcggtgcggcgcgcggtggccgctgctcctcagggggcaagtgggctgacttctctcgccgcgtcggctccaaagatcacagcctcgagcttcatcctgaatcgtcctcagcggcgctactcctcgtcgaaaccctcaagatccgatgagcccaacgatattgctgccggccagtcggtgccggcatctacctcgcgcggagagagcaaaggcagcaggaaacgaaagagcaaggattcagccgaccgaaatgcggctttcaagaaactgcccagtgtccctagcactcaccacatgtctcaagaggccctgagcttatcgagcttcttctcactccaccgtcccatttccatcacccagaccatgcccaggactgttaccgacgagcactttgcatccatatttgcgcctcgatcaaaatcgaacaggatacgagacactgtctctacaatttctgacaccattgagcagctggaaggccccatggctcaggtgacaataggatctcaggaccaaggggctggcgatggtatgcacagagttgatgtcaagaaccctgacggaaccgagtcgagcatctatctccaggttgacaccatgtctggagacttcttgcctttccgcccccctccgctgcccgaggcgcagcaaggcattgaggctgaaggagttgcggctgaggctgaagctctggaagaggcagctcaccaccgagtttacaaggccatgttcaccattgaggagtccacagagtcagacggccaaatcaggatcatcgcccacagccctcgaattatccaggacgagcagccccggagcttcttggagcgtctggcagtccgccaactgcgggttgaccaggctcgcggtcagcgtgacctctatgccatcagcgttaagcgacaacggaaacttaagatgaagaagaagaagtataagaagctgatgaagcgaacaagaaacttgcgtcgcaagctggatcgaacctaagggggctaggcttgggctgtgtagaaattcgcatttatttcatttttcctctattgcgttgggattcgaccggttcatgggttggtgtctgtctggcggttgacagctttttgtcagccatgagttacgcaacgcgctcctgagactttttctcttccatagactcgtgaagatgacttgttgtcatgtgttgtggtgcatggctggggcatggcattttcccgttacatcgattttgtaaaattagtatgaataagacgaacatgtatcaacacaaaaaaaaaaaaaaaa

SEQ ID NO: 2302 - DNA, 467 bp, Trichoderma harzianum
cccacgcgtccgaccgaaccgccagcgaatcgacgagggcatctgtgtcggtaccggatgctgcctttgcggatggagcgtcttcatcgagacggcaggtagaaggaaagacatggccttgtttgtggcgccgcgggcactggcaacgttggtccctcggcggtatcccctggagaagcagtggcgagagaagttgatattcgcagcgagcacggcagtcgtgtttacttgcgcccttgagaatccaaagagagttagaggcgtactaggggggattttgggcatggtgttgaagaaataaaccgggcatatgggcaaatatgatctcttttagggagttctgagacgtgacatgactaatttcttcttcttctttggatgtctttggaataagctacggtttttagatgatatacacaaacaaccctgatgctataattggtaataaatcaaaaaaaaaaaaaaaa

SEQ ID NO: 2303 - DNA, 1069 bp, Trichoderma harzianum
gggcgatacgtcgagatgattcgtccgcagcttcagtccgtgagatgctggtgctatcagatgctagcagatgttatcccaagttacccgatgctacagaccatccacgctgcagatcaacggccgcttcgtgatgcaagtctcacgcaaactttaccctctttcagttcttacgagatgcaagggattgatccactggagtcagagaatctgaaccgcgaccgcgaccgcgacggctacgcgcaaagtttgggccagtgactgacgcggccgttgtttgtcatcaagagtcacagagttcaatggccctcaggacagcggcatttgctgaatacgaagcgctgtgctcatggcatggggcaatgttcctgcagtagcgcgtgatatgcaaaacctctgtgcgtgcagcttgcatgatgctaggatgcaagagccactgcggttcactgggctgagcccccagactcctgacatggcttacaatacaatatggatgctgtgctcgtaagcaaaaggcttctccagtaggtaccttgctgcccgtttggaaaagcgccgagagcccatgagatatcgcaacaccgggcgattagtcgttttctcgcacagaacaacaacacatgcgggattaccacgacatacatgtgtgggagttattatttagccaacaatagtggagcatatacttgacaggcacaccaactcttgatgtttgtttttctcagcttcagtcgcggtatgatcaccaagagagcttgtgaatgctcaaaccactaccgcagattaccgatttgattcaaaccctcgattttatgccgccgcgtggcttgggcgcgattgagccctggtcgcgatcatatgtaaacgctttggccgccgattgacgaggcaagaggctacgcgggtttcagtgcgattctttgaccctggccgtcatggcaaactaggacgcccgagattctgatgaaacacccgcgatggccttgcgcatttgctatttcatacagagaggacggaacaagacatggccatcagcatcgttatcatcttgtccaaaaaaaaaaaaaaa

SEQ ID NO: 2304 - DNA, 817 bp, Trichoderma harzianum
acacaattcctcgctgcgtgtgactcgtgtctccagcaaataccgcaaagatgtctgacgacgggctctcaatatacgatgagatcgaaatcgaagatatgaccttcgacgaggttcttcaaacatacttctacccgtgtccctgcggcgatcgtttccagatcgctatcgatgacctgcgcgacgagcaggatattgctgtgtgccccagctgtagcttgatgattagagttattttcgaccttgacgacttacccaaacctcctcctactggcaatactggtggccagataccagtcgctgcttaaagccatcgctatatttgagcttccctgggcgaatacttgatctattcggcagacacatcgagatactacactaattaggcccgcatagcgtacacagtgcctcaacggccgttctgaagaggcttctcagattgatccgtctaacatcggatgtattgatagacgcggacgagaagacgacgatgtaccagcgacagaccaaagtcatcccaagcatccaagctactgatgcaaaaatatgcgtgccttgggagtaccactctccgaggcaaaaattcagtcacttaaagagacaggcttcgggaatgccatgaagaattcaggctcacgtgggggacatttgatgaaagaacactgccgaggcgttggcaatacagaatggacctatgaaggacggccatttcactcatataccgtcaacataacaaaccaagataccaagggtgtattacatattcacctaaattccatgaatgcaaactacaactgatgacaaaaaaaaaaaaaaa

SEQ ID NO: 2305 - DNA, 947 bp, Trichoderma harzianum
aaagaccaagatcaggacaagacaattcgagagtgccaaaaacagcaaaagggcagagagacgtcatcatggctcaggccaagttcgccgtttatcccagcctcgtcgaccgcaccgtcgtcatcacaggtggtgcgcagggtatcgccgccgacatggtcgagcagttttccctgcagggttctcaagtcatatttttcgacgtcgaggacgagcttgccgctgatttagtccgaaaagtgtctgatcagggcgtcaaacacaagcccatatactaccactgcgatgtcatcaagatcgacgaggagctcaaacccacagcggccaagatcctgaaagaccatcccaagatcgacggactcataaacagtgccgcgagggcaatggtgaagccctcgcaggatatcacgactgagtggtgggatgagagcgtcgccgtgaacctgcggcatcagttcttcctgacccaggccttgctgccggggcttctccttgctgctggaaacgcttcggtgattaacatggggagcatcaactggctcgtctctgcgacgggtcaggcgccttacacgacgagcaaggccgccgttgtgggactgacgaggacgctggcacatgagtttggaccgcagggtatcagggtgaatagtatcatgccggggtccattgcgacagagagggagaggacggtggttatgacgcccgagtatgaggccaaggttctgggcagtcaggcgatcaagaggctgattgagccggtggaggtggcgaggatggccatgtggttgattgcagatgatagtgctgcggtgacgaaccagagcatgaggattgacggtggatggacataggatgtgggctttgaataagtgaataatgtcggtttttagatactctgctgatggttggaacattgagatggcatgtataagaaaaaaaaaaaaaaa

SEQ ID NO: 2306 - DNA, 1028 bp, Trichoderma harzianum
gacgctatcgagggctgacctgcatcgtcgtcagtcggcagacgagcggattaacaacattctcgagacggctctgcaacgagcagaaacgatggatcccgcctctctaagccttctccagaaaggctcttcccacaattcctctcccaactatggagcctccggaacggtgacaagagggatattgcaagactatcaggcggtaccgaccagcgatgaaagcgatgccacccgtccgagaaaggtttcatacagcgatgcggcgaagaaggccgggaaccatgcgaagagccagagctctctgcggcaacgaaacggagtctccggctcggaggatacaagatcgccaacaaaagcaaagtcatcatggacgaaggaaacatttcgaaaatttcagtcccttcagttggaaaacaagggaagcgtggctagagatcacctggctctcgaacgcacatttctagcatggcttcgaacctctctcgcttttgcatcgattggcgtcgccgtgacgcagctattccgcctcaacactgataacgcttccgcctccgatttcgaccacacaaggctacaaaagatgggccgcccgttgggtgcgacattcctcgccattagtattgtgaccttgctcctcggttgcagacgatatttccatgcccaggaatggatccttcagggcaagttcccggcaagccgagggaccatcattatcatgtcactggtggcattggccctcatgattttgtctctagtggtggtcattgtcatccggccatcatagaggctttggacagctatggaatcaccgacttttgactgttgattttcagttggttcctttttggaatgaagaaggatctatgggcttggtacttgtgatttaggatagcattgggtttgaagcatgtgattaacgggttttggtgttttggactttgcagggtaaatgtttggatcatatatgcatcgatgtacatttgcaatggatagaggatatctcttcactggttaaaaaaaaaaaaaaa

SEQ ID NO: 2307 - DNA, 1546 bp, Trichoderma harzianum
ggaacgtcaagtgcgaaacgcactggtgtcgcctgacgaagcaggacaagagtcaatcaattccaaaccagccgatagatctcgaactctgttcaagaccaataccaagatggaaacgaaaataggagaagagcctatacgacataccgattttgccatgacagatgctcagggagggcgaggcccgctgcagcaaccagccaccacggcacgcaccggcttggcgatgggacgcaggttacaaaaattagctcgcccaaaacgctcggcaagtcatgaacagcagtacataggtgacgagctccgtggccaaactactaggcccagatcatcttacgacccgttggtctcaacagaatatagtctaagacgtccaaagcaacatgcgacacacaactcgactgcagaacctacggtaaatactgtcattaagcctactttacggcgacgaggatccgactctagtgagagcagtttcgtacgtagtaggtccatcggcagtcctcgaagtggatttaggtcatcgatgcgaagcagctctttcgatccgaggccatcatcatctggtaataagggtagaaacaggttgactctacgctcgttatcacccacaacgtcacatcagaggcaccattctgctgcgccagctgctccttctcggcaaatggtagagaatccaactcgtcagccgttccagcgacactcagttgcgccacgtatcagccagtctctatcaaggagagatgaggattcgacatacggcgatcacttgtcagattctagtgatgacgacatgaacacaactccgttgacaaacggctctatcacgggtgatgaaaacgaacccgttcattcgaggttgaaacaatctattcttaacatgtatgcacgcaacaacctccctgaccaaacttctagtgccagcgcaggtatcaactccggtttgccaaaacacgatgcgcccaaaccgagagttgaccaataccacaatgaggagaacccgcatctacctcttgatcagctacccggcgcctcggctcgccgaccagggctcatctccacactcaggcgcaagagccatgcaaacgtcaaagaatccagcgacgctgacggtgcccgtaatactctaccgcatcatcacagtgaagacgcaacgtctacccggaacagcgtcatacccaaccacgcaataggctggccattgcagaacaggaagggcgagacgaatgaagcttcaatgacgtcaccgcttggagacacaggaagacgatccgcagctagcggctctattttcaaggacgagctgacgtcagaaccccgccatcaacatgagcttcagctttatgaaggtagctcggatgcgaaccacgctaatactttcctatcacaagaacctaagcgaaagaagtttaacagcctgaggaaaatgtttaaaattaataattaggtaattatagaattcgaataatgagataagattatatagcaattaatggtgtaaaagaatttaatggcacgctagtttcgctacaaaaaaaaaaaaaaa

SEQ ID NO: 2308 - DNA, 317 bp, Trichoderma harzianum
gttcgatgcactgccaccatcctcggagaaaggtgtgtgtagtggacaatgtatgtgtgtcattgaagaaagtaggagtaggtggcggctccttggcaaagtggcaatgttgcttggtattatggatcggtgggttgtgcccagctggaatggcttgtcttggcgatagggggaatatggagtcgttttgatgggaacggcctttttggtttaccgaggaggggtcaacatgtgcgagcatgtatgttcaaagatgggagagggagagaagaagagagaaaaatcaagaatcagttgtgcctaaaaaaaaaaaaaaa

SEQ ID NO: 2309 - DNA, 1365 bp, Trichoderma harzianum
taattctatttcactcttctgcagacgaggacggacccgattgaccatgttgcgacaatccttcagagcctttgcccgcacggctgttgcgagaccggccgcggcgagaagctacgctaccttcaactgggaggatcccctcaatgcgaacaacctctttaccgaggaagagcaggccattgcagaaaccgcagagcgatactgccaggaacgactacagcctagggtcttgcaggcctaccgagacgaacactatgaccccaagatcctcgaagagatgggcgagctgggcctgcttggctccagcatcaagggctacggatgcgctggcgtttcttcggtggccggcggcctgattacacgagcggtcgagcgagtcgatagcggctaccggtctggcatgtcggtgcagtcgtccctcgtcatgggcggcatccacgagttcggcaccgaggagcagaaggagagattcctccccgagatggccaggggcaagctcattggcgcctttggtctgacggagcccaatcacggcagcgacccgggcagcatggagagcgtcgcgaagccgcatccgaccaagaagggatactactcactgagcggagccaagacgtggatcaccaacagcccaattgccgacgtgctgttggtctgggccaagctgcaagagacgggcaagatcaggggcttcttgattgagaggaaggactgcccgcctggaacactcgagacacccgccatcaaggacaagaacgggctccgagcttccatcacgggcatgatccagatggacggcgtcccggtgcctgaagccaacatgttccccgatgtcgagggcctcaagggaccctttagctgcctcaacagcgctagatacggcatctcgctgggtgtcatgggcgccctggaggatgccattgctcgagctcgcacctactccctggagcgcaagcaattcaaggggaaccctctggctaggtaccagctcattcagaagaagctcgctgatgccgccacagatgccgcctatggcacactggccgcggtgcaggtcggcaggctcaaggacgagggcaagatgactcccgaaatgattagcatggtcaagagacagaactgtgattcggctctgcgcaacgtccgcgtgctgcaggagattttcggtggaaacgctgtgagcgacgagtatcacattggaagacatgtggcgaacctgtttgtgacgcagacgtacgagggacagagtgatatccacagtctgatcttgggcagggcgattaccggcatacaagcctttgtgtaaaatatactagcaatatagatgatgaaataaaagcatataatcacaaaaaaaaaaaaaaa

SEQ ID NO: 2310 - DNA, 1378 bp, Trichoderma harzianum
cccacgcgtccgccctcatatattgaaggcatcgccaacccgatcacaaaccttcttgtccagacttgcaaaccactcaatcgattccttgataccccttgggacaactctacttgttctctccaaacttacccctccaaataccatcatcaccatcaccatgaccaacgacgtctctaccaacggctcttctgccgctcctgcgaccacctttgccctcaaggctggtctcgcccagatgctcaagggcggcgtcatcatggacgtcaccaacgccgagcaggcccgcatcgccgaagaagctggtgcctgcgccgtcatggccctcgagcgagttcccgccgatatccgcaaggacggcggcgtcgcccgcatgtccgacccggctatgatcaaggagatccaggacgccgtcaccatccccgtcatggcaaaggcccgtatcggccacttcgtcgagtgccagatcctcgaggctcttggtgtcgactacattgacgagtccgaggtcctgacgcccgccgacgacgagagccacgtcgagaagagcccctttggcgtgccctttgtctgcggctgccgcaacctgggcgaggccctgcgccgtattgccgagggcgctgccatgatccgaacaaagggcgaggccggcaccggtgacgttgtcgaggccgtccgccacatgaagactgtcaacagggacattgcgcaggccaaggctgctcttgccgagggcggtattgttcgtctccgcgagcttgctcgtaagctcgaggttgacgtcgagctgctgcgccagactgctgagctgggccgtctccctgttgtcaacttcgccgccggtggtgttgccactcctgctgatgctgctctcatgatgcagcttggctgtgacggcgtcttcgtcggcagcggcatcttcaagtctggcgaccctgccaagcgagccaaggccattgtccgcgctgtcactcacttccgtgaccccaaggtccttgctgagtgcagcaccggactgggcgaggccatggttggcatcaactgcgacgctatgaagcccgaggagaagcttgccggccgtggctggtaaataccccctattatatgattttagcaagggaaagcaagaggaggaaaagcaaaagtgtggtatataaaaacggaagagacagaggaggaaaaaatgactggcacagagcctcaaaatgtatctattctactgttggatttgggcgttgtggactttttatcgctttgggtggcacttagcatgctgaacatcaaaattctgaagatgccgtcaggatatgcaacctattgaggattatacagcatagcacgaaatctacatttacttgtttgcaaaaaaaaaaaaaaa

SEQ ID NO: 2311 - DNA, 432 bp, Trichoderma harzianum
agccgagttaagcggcgatagaagcaacaaaggtgaagttgtgccggtctggtggtttattggaaagaaacgaagagaagaatgttccggtcaagggaagcggcctttggtcagtagccaaagggcagatcaagcgccgccttggaggattaaaagggcggctgcaggggtcccaaggctggtgcgcctcatggaattgtatcgaagaaagtcgatggtgtggcggtgcccgataacgcaaaaagctggcaacctttgtgctgccatgcgggctagcagcgggtaccgccgagtatttgtttgtcactgtacagaggcgagacgtgaggccgagattcgcattggttcggagtctggagtagggaggacaatatggtagcacgattgtcattgtgattgctttgtttattagtacttaaaaaaaaaataaaa

SEQ ID NO: 2312 - DNA, 407 bp, Trichoderma harzianum
gatcgggatcgagtggggaaataagatggaagtcgagagtgccttatgtaaaaacctgaccaccggcaggatggaatcaccagaatcaccagacttgtctccgggtctttcctctatcctgcattttcctgcaggacagggagagctgcctgcacctgcacaccgaggtacctggatactccgcgtggtgaggggcaggcagcgtgcgtccgaggtactgccaggctgccaggtacttgggacggcagtgcacaagctccgtacttggcgcgccctgccctttggtccagctttgggaagagatctccgttccggctgcctatcctccgctttcgtgcagctggggggagggttaaagacggctttcggtcaagagtcgaatcggtcctgattcagaaaaaaaaaaa

SEQ ID NO: 2313 - DNA, 355 bp, Trichoderma harzianum
gaacaatgcagctggtgacaggtttgtcaagtggcaggggagaatcgtattcgtgtggcgatggtgatgtcgaatttcgaatgagggagccttggcgcgaagaaaaaagaagagagagagagagcggagaggagaggagaggagagtgaaagaaggagaagtagagaggagagaggagagagacgctgtggtgctaagcaaccacgagagaggaagatgaatgcggtttacaaggttgacattggcgaacgagcttggaccgctttgacaatgtgatgtgatgcaggctgggtactccaaatgtttccaattgaacgaatatccaatcagacaagtagagataaaaaaaaaaaaa

SEQ ID NO: 2314 - DNA, 603 bp, Trichoderma harzianum
cggacgcgtgggcggacgcgtgggcgaccaccagcgccgccagaatgttcgccgcacgatcaagggcagtctgcgccgcccgccagctgcagcggacaacccgaacctacgcctccgagtcccacggccaccactcgcccgctccggtcaacgagtcctttggggccggatctgttattgccctgggcgctttcctgggcaccgtcctagtctaccagttccgccccacggagagcgacaactggacgccctctgccctgctcaacaagtatcgatcaaaggccgaggactgggaggccgtcaacactctgcacacaaaggccatggagcaggccggctatgacaggaatctgttcgagaacggctccaacaagcaccgatttgtcgacgtcgcataccccgaagctctccaatcccacgccgcgcgaaacatccaggccggccaccttgccaacattgaccatgctgtggaacactaccgacagcagcacctgaagatggaggagaagaaggcggccaagctggcggctgccaaggcagagtagttgcagttgctacagtatatccaatttatagaacaaagtttgcaacaaaaaaaaaaaa

SEQ ID NO: 2315 - DNA, 424 bp, Trichoderma harzianum
cacgcgcatcattatgccggcatgggcccggggtctgaccctcaccatttccgagaccagagcgtgccgcatttcgacaaggcgggccatacgcggacgcacgagcgggaggatcaccggcggtggcagcggcagagaagggctgtgggggatgatggcatagagtttgagccgcagacgagcctggccgggcactttttgattgtggcggggatattggcggcgacgctgtttgtgccggcggtgtatttgcagtttatgcgcctggggaggcagaagaaggagaaggagtcgtgaggcgggtatggcgtctggagtgtgatagggaaggctgtacaaagaatagagcagacttatatagaaataggcaatgggggggcatgagcgaacaatgccgattttaacgttacgaaaaaaaaaaaaa

SEQ ID NO: 2316 - DNA, 1065 bp, Trichoderma harzianum
gttggaagtatagaacttagccggctacaaacttaaagagcgttgcccaaaatgaagccctatccattccaattcaacagcacatcctcgtcaaaagatgaaccaaccagggatacggagcccagtcatctttgtagggggcgaataccttctgtccaagcatcgcagcttcgggctatgattcgcgaagcatactcggacccaagcaagattctcgctacatgctgctctgacgatggactaggatcacgtctggtggaagaagctaggttcccgtacatatttttgggtggattcatggtcgcgtctagctttggattaccagacactggatacattgccttccaagaaatggtcagccgcattcaagaagttaaacgacaaactacgattcctatcattgcagatggagatactggatacggttctcccgtaaatgttaggcgcacagtccaaggtttcgccatggcgggtgcagcgggtatcatgatcgaagatcagacttggccgaagcgatgtggccatactaaagggaaatctgtagtgtccagggaggaggccttcgcacgaatccaagcagctgtggatgcccgcaatgaaggagtcgatattgttatcaacgctcgcacggattcttttatcctcggatgggatgaagcaatttatcgagcaaagaagttcgttgagattggagcagacatggttttcctagaggctctcccagatagggagatgatgaagaagacaattgacgcccttaatttccccgtcatggctaacattattgaaggcggcttgacagataacctctcagctgaggagcttggcaaaattggtttctcgatagttgtatatccctttacaatggtggcagctagagtcaaggctgtgagggaggcattggagtctttgaaagtgagtttcacatctggggcacctccaagtatcatgtctgccggagaggtctgtgaggctgttggcttcaacaagtactgggagctggaagagaagtataaatattagtggtatcaattttagtggtctaaatgataaaagggctagttc

SEQ ID NO: 2317 - DNA, 455 bp, Trichoderma harzianum
catttatcgagtttcacagggcttagcaactcctgtccggggggattggcagatcttgacaactgaggaggaccggatgccgtgacgtgtagctgctaggatgaatcttggattggagatttgccagtcgatttggatggtgcctttcgggatggaggggtggagggtggagagatatgactagtgtggaggtatcacagcgtcggggggctgtggagagttcagggtaagccatttgcggctttcacgctcagtaacactcgggggtttaaaactgactgatggcccatctataccttgcagaaaaaatttaggtcctcgcaagactctccctagagccgcgtcccgtcactactgctgctttggcatcaaatagtgctcaatggctaggccgagggatttgaagacgatagcaatgtaacccatacgatctgactgaacgaaaaaaaaaaaaa

SEQ ID NO: 2318 - DNA, 271 bp, Trichoderma harzianum
gttcgtagagaacgcagataccttcaacaggctcgaggctcccgtgtctcgtgttgctggatggagtatccacaacgctctgatattcgaaaagtttcacgtcccagatgttgcaagaatttacgacagtattaaaaagacggttcagtactaagaatgtggggagcgagtaacgtgtgactttatctttgaatttctagagcttcttcctagcataagtgtaaataatagagaataaagctttctgtaacacacaaaaaaaaaaaaaaaa

SEQ ID NO: 2319 - DNA, 24 bp, Artificial
  Synthetic
gatcttaattaagtcgacgaattc

SEQ ID NO: 2320 - DNA, 20 bp, Artificial
  Synthetic
gaattcgtcgacttaattaa

SEQ ID NO: 2321 - DNA, 40 bp, Artificial
  Synthetic
gccttaattaactgcagcatgtcgggtcgtgaagatgaag

SEQ ID NO: 2322 - DNA, 48 bp, Artificial
  Synthetic
ttgatatctagagcggccgcttatcatgtttcatcatcgaaatcatca

SEQ ID NO: 2323 - DNA, 59 bp, Artificial
  Synthetic
gactagttctagatcgcgagcggccgccctttttttttttttttttttttttttttttt

SEQ ID NO: 2324 - DNA, 51 bp, Artificial
  Synthetic
gaggatgttaattaagcggccgctgcagttttttttttttttttttttttt
